United States Patent 9,782,462 (MODIFIED POLYNUCLEOTIDES FOR THE PRODUCTION OF PROTEINS ASSOCIATED WITH HUMAN DISEASE) - sequence listing, part 27

SEQ ID NO: 30146 - DNA, 2308 bp, Homo sapiens
tggggcgcttgcaggtccctccccgcgcaagtgctcgccccgcccccggggccgcacccacagccccggctaccccggagaagcctgacttgagaaccctttctgcagagtcccggcagtgcgggactccggtagccgcccctccggtagccgcccctcctgcccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcgcaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggtgcttaatttacccatttctgatgcgaggaggaaagcctatgccactgttggcgtgtacaatggcgattatgttctgtacctgtaacggctatttgcaaagcagatacttgagccattgtgcagtgtatgctgatgactgggtaacagatccccgttttctaataggttttggcttgtggttaacgggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccacagaggctgggggtagccattgtgcagtcatggcccgggggaaacttgccaaccttcgtgtcaggtgctgtgtgtaagtggagaacttggggatagaggaggaagctcctcgtggcccttccaaggtgaggcaaaggcatctggacttgttccagcccagcccaccgggtgacatcaccgggcagggaggggtgctggtggtggttcatacggagtaagctgctctgcctgtgtgagtggctcctgggccctaaacaggcacctttaggccatgggtcactcaccgtgagccatcaatgtgctctggtctgacatggtttctctctgtcttctagtctagacctagtttttttgttctgttccccacgtatggatatagtagagattgttgtctgtgaaatttctcttttgtagattttgagttttcccttgtagtgtaaagaatgatcactttctgtaacaataacaagaccactttttaagatttatcctgtttgttctttgttgattgaaacataataattgttaaaattctctacagccttctttttcttccatagctaatcttccttctaatagtttttgctttctgttttgctgttgttgctttgcaaagctttcccctcatagcctgtacctgttatcaatataaaataatcttcctgttgaatgcttcatgacttgaattctactttgataaaaacattgccatactgctttttatcttgatgaattcatctggcattgctttgccttatcatctcatctggagtttttaaatgccatttgtttcagttgtctttaacaacataataaatagactttgccatttaa

SEQ ID NO: 30147 - DNA, 2013 bp, Homo sapiens
ctgacttgagaaccctttctgcagagtcccggcagtgcgggactccggtagccgcccctccggtagccgcccctcctgcccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcgcaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggaaatgttggtatgcaagcacttgcagtgtgcctacatcccaaatgccagcccatggtacccattgtctgcccggatctgaatcatgattccaagacgcagagagaaattgctgggattcgttgttcttattcattgcttggcaacactgcagcttccaggagaatacccacctcactgatgacacaacatctgaatgcacacttactggccaacacgtgctttgctgtaaatcagtatgaagtcttcctaggggtcctggcctgaatgagatgagaaccttggaggctgcttttgactcatgtgaatgtcttccccaggagttaagtgggagtgctggggagagagtggcttgaggatgcacagccagcatgacactactattatgtgattactgtcgacgttcataaccataactaatgactaattatgactttaccctggcgcacatggtcagaatggaaacaaataacaagctttacagtttttcctgctctattaaggtgcttaatttacccatttctgatgcgaggaggaaagcctatgccactgttggcgtgtacaatggcgattatgttctgtacctgtaacggctatttgcaaagcagatacttgagccattgtgcagtgtatgctgatgactgggtaacagatccccgttttctaataggttttggcttgtggttaacgggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccacagaggctgggggtagccattgtgcagtcatggcccgggggaaacttgccaaccttcgtgtcaggtgctgtgtgtaagtggagaacttggggatagaggaggaagctcctcgtggcccttc

SEQ ID NO: 30148 - DNA, 935 bp, Homo sapiens
actccggtagccgcccctccggtagccgcccctcctgcccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcgcaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggttttggcttgtggttaacgggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtc

SEQ ID NO: 30149 - DNA, 1929 bp, Homo sapiens
agctgagcctggagtttctgaagacaagggctagaaatctgcactttaaagtcttgaaaaccactgtgtgccttcatctaagctgcccctgcttctctcccctccatccctcgcctggccctgtcctccctactctcccctgcaccctcccccgccccaagctccccacaaacggccaaagcagcagtgtgaggcaatcgctctatccttgaccccttcctttgcacagtgagtgatggcgtttttatctcctgatgatgatgcacagccttcagcgggggacatttaagacgcagaacaccaggtccaggctgcagctgcgggactcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctagaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacacaaa

SEQ ID NO: 30150 - DNA, 1567 bp, Homo sapiens
gtgatggcgtttttatctcctgatgatgatgcacagccttcagcgggggacatttaagacgcagaacaccaggtccaggctgcagctgcgggactcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaagggttctcggctagaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaa

SEQ ID NO: 30151 - DNA, 2003 bp, Homo sapiens
gggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggaggacattcctgctcttgaaatttcctgataacccggacaagttcatggaaagcttgatctacattcatcctaatctttgctgatgcctccatgtatgttaccttaagttgccgtgctaactgccgtccttcttcctgtgttacctgtctttgatgatccagatctgctttattaccaattaaaatcattgggaactcatcacgatcctttactctgagaatctgtctttgaaacttatagatttcttcaaaactgcctctatctgtgactgaaaagaccaacaggaagccctcgccagtcctcatatactgttctctcatggctccaagctcttcttgtcctgctgtatccaaaatatctagccgggctgctctgtcatctatcacacactgctttgtgtaagaatcttcattggttggatcataatccgttacaaaataggactcccaacttaggaaacaaaacatttgtaatatgattgaagactcctgcatgcctcctcaataatattcccctctctcctcccccagcaccaagaggtaatcaatatcctgaatttggtatctgtcattctcatgcatttatacaacattagtaatcatatgatagtattcctaagctatgttttggagaggacaccactgcaaatcttcagccctatactagcttttatcggtagccatcaattgcagttttaatagaaatacaaatacatcaagtgtctgttctttaatttgtaaagaaaatttgttttctagcgtgacaccctcaaggtaccgtatctgtatgtaaatgttgtgcccaatgctacacagacattattttaaaactattttctgcctttggtaaatagactaaactgttttctttattcctcaaaagaattagatcatacttcagtgttgattttgttgctaatgggacatggagatgtctggatgataataaatattcctgtggtatggtcactgaa

SEQ ID NO: 30152 - DNA, 2811 bp, Homo sapiens
gcgccccaccccgccccctcctcctgcccctacgcacgcgcactctcacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggcctctcttgtttttactgtgtatgttcttgctcagggctctctagataatgcagaataaagagaaacgttgggggatttataaactgaatgtta

SEQ ID NO: 30153 - DNA, 2239 bp, Homo sapiens
gttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaaga

SEQ ID NO: 30154 - DNA, 1298 bp, Homo sapiens
gaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggcctctctt

SEQ ID NO: 30155 - DNA, 938 bp, Homo sapiens
ggggaagccggaaagaggcaagttcctggtgcaaaggtggctctgcagcataatttaggcattggaggagctgtggttgtaacactctacaagatgggttttccggaagccgccagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggcca

SEQ ID NO: 30156 - DNA, 894 bp, Homo sapiens
ctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgc

SEQ ID NO: 30157 - DNA, 3926 bp, Homo sapiens
agcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagagataagaaggctgactgcacaatcacaatggctgactcagacttcctggctttaatgactggtaaaatgaatcctcagtcggtaagtatgatggagcttatatcctgctagtaggtaggtctttcagccctttctactccatctcctgactcagactctaaagtgcaaagtggtcagactcacaaaactcagtgttccccaaacagttgacagacgtctgtggagcaagctgtgtgccacacactgtcttgtgtgctggaagtgcccagaagagtaagaaagttcccacgctcagggcatccacagatgtgtaaaagagtcagtgcagccagagatccaaggtgccacacctggcttgtggtcaggggaggatgaaggcaggagcagccatatctctctgggccatcagggagagcaccacagaggaagcagctcttgagcttagtacccaggcggaaagtaggagtgttccaggaggagggaggggtggcatgaacaaaggcctgaccttttacattccatttatttgcccatgctcttctttttgcctgacctgtccttacctgacaaatgacttgtctttcaaaattagctcagatattatctccaaggacctctttccaagttgctggggagctgtaaccagtccctctcctgagccacgtactggactgccagcttagtgcctgttgtgttatgttagtcataatatgcctctctctcttccctgttaggctgtgagtgtctcaaagcatcaaagcacatcttatttgtctttatgtttccagaatttagcacagtatctgatgtttttaggtattctgtaaacaactgttggactaaattgcatttgtctaaagtgtgtttatgccttgtatagattttcctagtccccaaattgtcaagggtcctcttaggctcttcagctgcagtgttgaatggacttgatatagtgagctttctgtcaacttgatatatactgagctttccattaataaaaaagaaactaagacgtttctttccaatgtaacttaattttttctgttgtctcagtctggtttgttttaggttttattcctgtggttctctggtaatttccaagattggataaaacaactaaatctcactcccacttgcttttttaaaatgctttttctacgtaaccaagcacattttagttgatgccatgacaagtgagaaatttgcatctgtgatgtttcagctgaatacacaccattggcactgacatttccactgagcctgctccagaaatctggacagaacagaggccaccagtataggagctggctgtcatcctccttcccacccactgcacatgccatgcacagctttggcaggctgttcagacttcacacatcagctgccttcattctctcaatttatctttgtactgcccattttgggggcaaggtgtcagcttattttccttcagcacctgttaacacccaaaggaattaaagataaaaatagcagacctttctattaatgtgctaatggacttcccttatgctcagaggatttccagaggatttgactggaaatcgttaaatgcagtggaaattctaatttcagtgtttggctccagcagcaagcgtacatgaagaacacctaggggccagattaaaatcatctttatgtatggactctctgaagggtgaagattcatgttttctctattgttagtaaataaaaagtgattttctttgttaacttacaaaggagaaaggtggcgagtttctcctgtactactggtccgtatttttaaatgatgtttgttcaatatattgtgttctgagacacctgacctttaaggcatcagacagaaggctttgtgccatatagaaaggaaatatttagtttgtccagacagaggaaggggaaaaaaaggaattagtcacccttaccaggaggtacagaaaaaaacagagctccttacattcccatggatgatgtagaagagctcctagcttcttaatgtactgttaaaaacctaggactaccagaagctttttttttaaatctagcccttccttattttaagcattcagttaaaatactgagatcatggcagggaaattatgctacgttcccaattttgctgtttctcttaagttttcctgggattttgttacatggtaaatttagcaaacatcatgtgatctaatcccaggcagttgttaaatggaacaaattgtggctctgcacttcagattggtttgatttttcttgttgagccaaagagtaacacaagcacctcattctcagcaggctctgtgccctctgtagggataagtcctttatcattggtggcatttcattcacatgcatgttggattgaatcccaagagtttctgtgttttttgtgtatgctttttctctcagcagcctgctaaaaatttcagttcatatttcccacctacatggaatgttttaaaacataatcagtgtagtatgaacccactttgaggaggacaggtgaaaacaggctcaatttctatgagaaatttgggaaagctgctcctttctgctgatctgcaaaaagtgtggcctttacaaattcttccttttgaagaatgtggttccaaatctattccagaaagccaagtttcatattttagagaaagtcatgtgacctggataaataaatgatctcagggctagatagtgtagaaacatcagcaatcttaaaacaaaaaaacaccaagtaatgaattttctttcttcttcacaggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 30158 - DNA, 1896 bp, Homo sapiens
gttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcgga

SEQ ID NO: 30159 - DNA, 1889 bp, Homo sapiens
gttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcag

SEQ ID NO: 30160 - DNA, 6835 bp, Homo sapiens
agcttagcaggcgacgttgcgggccctgggcgccaggagagcttcccggagtcgaccttcctgctggctgctctgtgaccgcttcccggctctgccctcttggccgaagtgcccgctgccgggcgcgggcctcagacaatacaatggtgggtgaagagaagatgtctctaagaaaccggctgtcaaagtccagggaaaatcctgaggaagatgaagaccagagaaaccctgcaaaggagtccctagagacacctagtaatggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaacacttaggaagaaatcacttaaatacctctggcttagaaattttttcatgcacactgttggaatgtatgctaattgaacatgcaattggggaagaaaaaatgtagaatgatttttgctatttctagtagaaagaaaatgtctgttttccaaagataatgttatacatcctattttgtaatttttttgaaaaaagttcaatgttcagttttccttagtttttaccttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttgaattattttgcagactagtgagtctgtaccataagtattaatcacctccactcatattaaagtgatcattaagaatccagaagctggcttctgcatttgctcagttatacttttaatggtagtatgtttttaggtggaataaattaatatgtgattggtttcaaggaaatgtactctattatgtaatacttccattttataagatgcccatttctaatacaatgtgtgtaggaattatttgtatgtatgaggtatgattgtaaagattgagcattggaaggggtatcagagaccatgtagttcaactttccactcaaagtaagatttatgaattatttaaatgatagttgttacttggaacagccacttgagaggctctcttggtattgtttggaattgttttaaagtcagtttgagtctcacaagaaggtaagtagagtttcttaatagtcacaacttaatttgaaccacaagtatccagcttaatcacgtatcttactcacgataccactggtccagatgagtttaggtaattttcaaacattaaatccaacttcaacggaaacaaatacactcaagggaagttatttttaaaaaggtactctgcatgttcccgcagtaatgttctgcacaacagtattgtaattgtaatggaatcataacctgctaactagtttgctttaatatggcttgtaattcttgacatttttcttaaaattaaaacgaatttttattttgaatttataactgcattttaaatatattggggacagattgcgctgagacctggttatgagcaagccaatcttttgaatctagagaatggaattcttaggtttatatttctgttaagaaatactataaatatgactcttatgagaagactttgttgctctgtagtgtttctgaatactgtatttgttggattgatcaaggctatttttcaaaaagctctctgcttcctgtttgtttgtttgtttgtttttgagacagagtcttgctctgtcgccggggctggagtgcaatggcgtgaactcagctcactgcaacctctgcctccctggttcaagctattctcctgcctcagcctcctgagtagctgggattacagggccacgcctggctaatttttgtatttttagtagagatggggtttcaccctgttggtcaggctggtctcaaactcctgaccttgtgatctgcccacctcagcctcccaaagtgctgggaagacaggcgttagccaccgtgcccggcctctgtttcctgttattagtgattttcctgcccaagattgcaacaacaaatatgtagaactacagactgtttagaatgctgagactgttctaagaaactttcaaaaacagtagcacttcaaggaatggtcactttctatgaaagaaactggtttgatagccataatcttattgctagctgcttttagcaaaagtcttttcttgaaaccaccacctatactctttaaacaaataaaaactaaaatctcttgctaatgtttcaggaagatttattttttctattttgctattgtggcgaaaattattttcagttataggatacttttttccttctgaaaagtaataagcttaaagtttttgtttctgtaagatgtaatgatagtaactattattttgggcatattaaccaacagaacaattatgtagtatgtatatcactttctcattagatctctaacttgaccttctagtacctttatgtgtgaggataaatttgttagatccttttattctcaatcttggataatgatgcaaaatggaattttgttttgtttgttggtagattcacatactaaaactttgcaggtaaagttgcttgcctcatgttagaatttaattagaaaactgaggctgcctttttttttttttttttttttttttaagacagagtcttgttctgtcgcccaggccagttttttttttcttgtacagatggggttttaccatgttgctcaggctggtctcaaactcctggagtcaagggatctatttgcctcagcctctcaaagtgctgggattacaggtgtgagccacggctcctggctccttgctccagaatcagttttttaatggaagatagctcatactttgtttttgtttttaaagagacagggtctcactctgttgcccaggctggtagtagcgtgatcatagctcactgcagtctcaaactcctggactcaaatagtgctctggagtacctagaactacaagtgcctaccaccacacccagctaatttatttgtttttttttttttagagatggggggggtctccctatgttgcccaggctggtctcaaactcttcacctcaagcaaaactcccactgcagaaagctttgggattacaggcatgagccaccatgccaagcccatacttattgttaataaagtttcagtgacttgcttactaatcttatgcaaaatttcatgtaatttatgtaatactacataacaatgctacatatggtatgtatacatacactgtatacacacaaaggtctgttctgggtattttatgtatcttatctctaggctttatggctctgaaatggagggaactggacataaatgtttcaaggaataaagtgaatgttttgtttgtttgtttgttttgagacggagtctcagtcaccaggctggagtgcagtgctgtgatctcagctcactgcaacctctgcctcctgggttcaagcgattctcctgcctcagcctcccgagtagctggcattacaggtgcctgccaccatgtccagctaatttttgtgtttttagtagagatggggtttcaccatgatggtcaggctggtctcgaactcctgacctcatgatccgccagcctcagcctcccatagtgctgggattataggcatgagccatgctcccggccaaagtgaatgttttgggtgaagtttatataaggatttgacttttgtatcattattaaagtttctgtcaggtaatacagtgttggccctctgttgaaataaaatgttacatatcgctgggtgtagtggctcatgcctttaatcccagtactttgggaggccaaggcaggaggattgcttgagctcagaagtttgagaccagcctgggcaacatagcaaaaccttgtcactataaaaaatacaaaaattagccaggcgtggtggtgcacgcctgtagtctcagctactcagtcggctgaggtgggaagatggcttcaagccgggagatggaggcttcagtgacctgtgacctgtgatcacaccacttaattcctcaaaacatttatgtcccagttccctccatttcagagccatgggcaacagagcgagaccctgtctcaaaaaaaaaattacatataagcccggtttaaagagaggataatatgcaaccaccctagttgaaacagagtgtatcacttctttctcaccctaaatttaatgcctagtttgaaaatcagtagacaataataaagttgataagctttaggttggtaggaaagctatgtaatctatatagtgtactaaatccttatatgtttttggtaaaaaaagactttaatagctaatttggacttcagaaaatgggttaatttcacgagtgcatatcacttttgactatattagtcaagcatattattaaagtttaaaaaactctaaaacttctgtactgtttttttcttaagtgctctcttccttatttctacattactacattcacatttctgctgtcaataagccctaatggagtgataaactttaagctagtagatactgcaccatgtcttgtggtggtgttttcttaatgaaatggaagctgtacttcctgtttgtttttaaatacttttgaaacagacagttcatgtaccccatcatttagagatgcagtttgaatttccatggaaaaaggtgccaattttggattgggaaaggagctgaagccccagtcaagactttgccatttggggtaatgcagcagattcctgtgtctgtatctttccagtgtgtgtgttaatccatagtgttctgagcaccagaagggtcatgtaaatctgaagttgttattaaaggtttttctatagtgaaa

SEQ ID NO: 30161 - DNA, 870 bp, Homo sapiens
gtattagcaagacatgaaaatctgtaggggcaccagaacctttaatcaagctcatgttttattgtaaaatattaggatgtagacaatacaatggtgggtgaagagaagatgtctctaagaaaccggctgtcaaagtccagggaaaatcctgaggaagatgaagaccagagaaaccctgcaaaggagtccctagagacacctagtaatggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcag

SEQ ID NO: 30162 - DNA, 1941 bp, Homo sapiens
gctttagcttagcaggcgacgttgcgggccctgggcgccaggagagcttcccggagtcgaccttcctgctggctgctctgtgaccgcttcccggctctgccctcttggccgaagtgcccgctgccgggcgcgggcctcaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcaggattttctgactttactggctatctataatgcatttgactaatggaaaggacacttgcaggagactttctttgaagagacatctttttcctcctgcttttgtagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggt

SEQ ID NO: 30163 - DNA, 1848 bp, Homo sapiens
gtccggcgctttagcttagcaggcgacgttgcgggccctgggcgccaggagagcttcccggagtcgaccttcctgctggctgctctgtgaccgcttcccggctctgccctcttggccgaagtgcccgctgccgggcgcgggcctcaggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaag

SEQ ID NO: 30164 - DNA, 2104 bp, Homo sapiens
gctttagcttagcaggcgacgttgcgggccctgggcgccaggagagcttcccggagtcgaccttcctgctggctgctctgtgaccgcttcccggctctgccctcttggccgaagtgcccgctgccgggcgcgggcctcagacaatacaatggtgggtgaagagaagatgtctctaagaaaccggctgtcaaagtccagggaaaatcctgaggaagatgaagaccagagaaaccctgcaaaggagtccctagagacacctagtaatggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactg

SEQ ID NO: 30165 - DNA, 2044 bp, Homo sapiens
actgcgaaggaaggaggcaacacgggcaagggctgcctgctgcccgctggagaccgcaccatggagccaggcggggcccgtctgcgtctgcagaggacagaagggctgggaggggagcgggagcgccaaccctgtggagatggaaacactgagacgcacagagccccggacttggtacaatggacccgacacatggaggctgtgaaggcacaattgctggagcaagcgcagggacaactgagggagctgctggatcgggccatgcgggaggctatacaatcctacccatcacaagacaaacctctgcccccacctcccccaggttccttgagcaggacccaggagccatccctggggaaacagaaagttttcatcatccgcaagtccctgcttgatgagctgatggaggtgcagcatttccgcaccatctaccacatgttcatcgctggcctgtgtgtcttcatcatcagcaccctggccatcgacttcattgatgagggcaggctgctgctggagtttgacctactgatcttcagcttcggacagctgccattggcgctggtgacctgggtgcccatgtttctgtccaccctgttggcgccgtaccaggccctacggctgtgggccaggggcacctggacgcaggcgacgggcctgggctgtgcgctgctagccgcccacgccgtggtgctctgcgcgctgccggtccacgtggccgtggagcatcagctcccgccggcctcccgttgtgtcctggtcttcgagcaggttaggttcctgatgaaaagctactccttcctgagagaggctgtgcctgggacccttcgtgccagacgaggtgaggggatccaggcccccagtttctccagctacctctacttcctcttctgcccaacactcatctacagggagacttaccctaggacgccctatgtcaggtggaattatgtggccaagaactttgcccaggccctgggatgtgtgctctatgcctgcttcatcctgggccgcctctgtgttcctgtctttgccaacatgagccgagagcccttcagcacccgtgccctggtgctctctatcctgcatgccacgttgccaggcatcttcatgctgctgctcatcttctttgccttcctccattgctggctcaacgcctttgccgagatgctacgatttggagacaggatgttctaccgggactggtggaactcaacgtccttctccaactactaccgcacttggaacgtggtggtccatgactggctgtacagctacgtgtatcaggatgggctgcggctccttggtgcccgggcccgaggggtagccatgctgggtgtgttcctggtctccgcagtggcccatgagtatatcttctgcttcgtcctggggttcttctatcccgtcatgctgatactcttccttgtcattggaggaatgttgaacttcatgatgcatgaccagcgcaccggcccggcatggaacgtgctgatgtggaccatgctgtttctaggccagggaatccaggtcagcctgtactgccaggagtggtacgcacggcggcactgccccttaccccaggcaactttctgggggctggtgacacctcgatcttggtcctgccatacctagaggtcgggacagacgacgctacctgcccagacaccaccaagttctctgcctgcaaaacctgggaccaggactcctgtctgcattcccaaatttggctctgagtcgaggcaacctgcacacaagaccccaccaaggaatgtgcaaggactgagatctgcagacttgtgggtaactgatcacagacctcagcatgggggtgaccagggtgactcttcaatccctatccccatgggctgggtacaggatatcctcctaccccatgactgtcttagggagacttggggtaccttatggatttgatgaatgtgggggaactcagaggaactggggccaccaaggttggaaaagggtttggttcttgactttgtattccttccaatacagcaataaactttgtctccctttttattcattc

SEQ ID NO: 30166 - DNA, 5240 bp, Homo sapiens
ctttctgtgcggcgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccacccagca

SEQ ID NO: 30167 - DNA, 5697 bp, Homo sapiens
ggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagtttacggaaaaaaatctggggcaactcacagcattgaggaagagttaaacatccacatttcaagaggaacaagaaccagaacactcctcagcagcaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagaccacctccacccccaccatcaaccctggcaactttgtcctgtaactaaaatagcctttagcacatggcataaccggagagcttttgacattcctctttggagattcatgtctgcgtcttgggggcattcggcactagtgatgggcagccctgcctgctgactccccggctgtttctaattggatctgagtattctaagagaaactgtaaaatgctccaagacagaaaggccccacgaggtcctatccttagagccaaggctgtagcatttcctatcaagcagacccttaaccggcgcacaggaaggagctgagaagagtgagtatactgtggggcgtggcagtcactggcttgggcccctctgcctgtcacgcaggtgacacatagtgacctgcctctcgactccctgtcactgctgcaggagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccc

SEQ ID NO: 30168 - DNA, 3565 bp, Homo sapiens
gcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctg

SEQ ID NO: 30169 - DNA, 3106 bp, Homo sapiens
cctagctaggagccaggcttgggaactctcaaatgggtaattcccggtccttgttatcagctagctcacaacatgctgacctcaggctttctcttactctagcagaaacaggtatgttttactttgtgtcccactatggatagactgctgaatacatcaggtatgttcaagcattaccacatctctatttgtttccgtatctcagtaacagcagagatgagctgagaatgaatcagaacgtgccctgtagtgacattgatatatttcctgaggtacatcacgatagtctaggggacaaagggcgcagggaagcccagtgtactctttatgtctacacttgatcttagccagaaggctgagaagtgatactttttatgtcttacctctgtttctggtgactacagataagagactcatcccttgattcactcattcagcaaatatgactgagcaccgtctctaagcaggacatttgccttgtcctcagggagcatagttggcaaggaatctagacagcagcccttcttgagcttgacattgatcttctcatgaggaggactgggctccagatcttcctgggaccaggtcttcaggacagtgtgagctaggttatcagctcagattcagtgagtgctttgtggaaggttggcagagggtcgcgagggtcctctacatttgttctccagtatccagtatcaacactggttaccaaagaggaaggacggactattggtgcccctggtcccagtgattagaaatagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagaccacctccacccccaccatcaaccctggcaactttgtcctgtaactaaaatagcctttagcacatggcataaccggagagcttttgacattcctctttggagattcatgtctgcgtcttgggggcattcggcactagtgatgggcagccctgcctgctgactccccggctgtttctaattggatctgagtattctaagagaaactgtaaaatgctccaagacagaaaggccccacgaggtcctatccttagagccaaggctgtagcatttcctatcaagcagacccttaaccggcgcacaggaaggagctgagaagagtgagtatactgtggggcgtggcagtcactggcttgggcccctctgcctgtcacgcaggtgacacatagtgacctgcctctcgactccctgtcactgctgcaggagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttattt

SEQ ID NO: 30170 - DNA, 2456 bp, Homo sapiens
atgtttgtataaacaccgtaaacctgcctggtaccaccatgaatgacacaagagctagtttaaaaagaaagcaaagaaacaaacgcaaaacccgaaaccgcatcctccaccgcaaaggtactcggatggggcgcccgccctccccttagtcagaggacaaagggggcgtggccgagcgcgcggcgcccacgtgaccgcggagagctgcgcgcaggcccttcgcgcgatctgccgtcatatcagcttatggcgccggtcgctgattggctggccgctccagcctcccggcccgcttgctggctgcccagctgctaggacagtttgcagagcagtggcgtgcggagcggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatatccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgtatcagttgagtattatagcagcacaaagtattctttgtacagattttgtgccaattt

SEQ ID NO: 30171 - DNA, 2258 bp, Homo sapiens
tacacctgagcgggctgggccggggggcgatggaataaaagaagatggagagacttcagcgcctgggactcgggtgggcgaggcggaaggtgtcctcgcagcacggcttttctccgcgccgcggttggttagcgagtgccctctgggtgctaggcgttgggcggatggtaggatcgcggtagcatacggatccgagtcctgcgccgagtgagaggagaggctggcaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatatccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaa

SEQ ID NO: 30172 - DNA, 751 bp, Homo sapiens
ctcattggctggaggcgcggggcggggttccggtgggcgcgcgttgaggctgcggtcatggagggagcaggagctggatccggcttccggaaggagctggtgagcaggctgctgcacctgcacttcaaggatgacaagaccaaagaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctccca

SEQ ID NO: 30173 - DNA, 805 bp, Homo sapiens
ctcattggctggaggcgcggggcggggttccggtgggcgcgcgttgaggctgcggtcatggagggagcaggagctggatccggcttccggaaggagctggtgagcaggctgctgcacctgcacttcaaggatgacaagaccaaagtgagcggggacgcgctgcagctcatggtggagttgctgaaggtcttcgttgtggaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctccca

SEQ ID NO: 30174 - DNA, 2565 bp, Homo sapiens
aaaggggccagaaaggggcaggctgaggctgggggaggggctcaagggagcccagctgggagggcccaggcaggcagtgcggagctggccgtgggctgcctaccctttcatctctgcaactccttcctccctgggcctcccttctggtgtgtctgtgggtctgtctaggtgggcttgggaaaggggaaggaaggggcgtctctttaggcagctcagactggacaagccttctttgaaaatggtcctttgaacacacgcctgctggtggttggtcagacagatgcgccagcgggagccccggggccccaaggggacagctatctctgcaggaccagtgcgatgggcgggaagggaggaggggacacgagaggccctgtcctcttcccgtgccagcttgctcaggccctcagtcccagacgggcttttcccagagagctaaaagagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcag

SEQ ID NO: 30175 - DNA, 2864 bp, Homo sapiens
agatcaaacaccttttaaagcaggtgctggggacacttctcagggccaactgccgagaccacacaaccagccacccctctaggatcccagcccagctggtgctgggctcagaggagaaggccccgtgttgggagcaccctgcttgcctggagggacaagtttccgggagagatcaataaaggaaaggaaagagacaaggaagggagaggtcaggagagcgcttgattggaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaagaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaa

SEQ ID NO: 30176 - DNA, 2800 bp, Homo sapiens
gtatttccatcaccgaggcccaaaggggccagaaaggggcaggctgaggctgggggaggggctcaagggagcccagctgggagggcccaggcaggcagtgcggagctggccgtgggctgcctaccctttcatctctgcaactccttcctccctgggcctcccttctggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaagaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaa

SEQ ID NO: 30177 - DNA, 2889 bp, Homo sapiens
acaaaaagggtttaccaatgagacacatgttgcctccttcatggaaaccctaggagaagaaacggacagattccccttccctgcctccgccccagcccagccccagcggtccgtctcactcggttgttgctgtaatgctggtctcctgtctgtgtgcggcactgcagatgtggcgggcaggggcttgggagctctggggcaggcgctgaaggcaggagaagggccagagaatgtcgtcccagccagcagggaaccagacctcccccggggccacagaggactactcctatggcagctggtacatcgatgagccccaggggggcgaggagctccagccagaggggggggcctgacgcaggcctgagccagccttcatttgctctgcagggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaagaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgag

SEQ ID NO: 30178 - DNA, 2832 bp, Homo sapiens
agatcaaacaccttttaaagcaggtgctggggacacttctcagggccaactgccgagaccacacaaccagccacccctctaggatcccagcccagctggtgctgggctcagaggagaaggccccgtgttgggagcaccctgcttgcctggagggacaagtttccgggagagatcaataaaggaaaggaaagagacaaggaagggagaggtcaggagagcgcttgattggaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaagaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctg

SEQ ID NO: 30179 - DNA, 1935 bp, Homo sapiens
agatcaaacaccttttaaagcaggtgctggggacacttctcagggccaactgccgagaccacacaaccagccacccctctaggatcccagcccagctggtgctgggctcagaggagaaggccccgtgttgggagcaccctgcttgcctggagggacaagtttccgggagagatcaataaaggaaaggaaagagacaaggaagggagaggtcaggagagcgcttgattggaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggtaacttgcccaagatcacagagttgagactagtcagagcctggatttgaacctagtgttcttgcccactgaacgtgctgaagggcttggaagctggagaccgaagagaggcctgggtgggctcactgcaggccccatgtctgcccctccagcatgggtctctctgcttgtttcaccttccaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaaggtaaccgctgatcacaatggcctagggcagaggggcgcacagagcaacctactcaaaccacagtgcctcctttgagctctgattctatgatgggccgccctgcagccttccattgtgcatgggattccatgccttcaaacatgtgccccttccaagcttggctgctctgcaggagaggcagggaacaaggtggctgggcccagccctcaggaactttaagtctaggaggtggcggagaaggggaagtgggcagagtagggggaagagaaagcctgaaatggcccccacccccaatgcctgtgttagtgatcccccagcttccctttggtcaggctggagagggaatgggagtgaagcttgatggaggccggcaagtgcgaagtcagggatggtctaagagggctgagaggagaattccggaacctcaggaccttgctcactggctgctggctggggctgtgaagctgtccagtctagaactcaaagagtgatggtacaggctttagagccagacaacctgagtgtgaatccagcttcaccacttcattcattcactcacccattcattcaacaacatatttgaagcacatactttgtaccagggacatttccaggcactggactacagctatgaacaagacaaacagtccctagcctcccaagagccgtcacttcagaagggcagacatgacacgcaaacaaaatgatgccaggtggtaccaagtgccttggggaaacagtgccacctttctgagaccgtttctccatccgtccatggagctgataacaccagtccctcagggtggaggtgaagactaagaggttgctttgagagggggaacttggtggctttttttcaccacctagaacctggcacatactaagctctcaataaaagtatattgaacc

SEQ ID NO: 30180 - DNA, 2730 bp, Homo sapiens
atgggcgggaagggaggaggggacacgagaggccctgtcctcttcccgtgccagcttgctcaggccctcagtcccagacgggcttttcccagagagctaaaagagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaagaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctg

SEQ ID NO: 30181 - DNA, 2631 bp, Homo sapiens
gtgctcaggtgaggggggatgcagccgactgtccagcagcgttggaggttgcaggcatgtacttggggtgaagagcaggactccagaaccccagcctgtctgtgagaagtgagaaatagaagagaaagctccgagggggcctttttcacttcccctgggaatagatcatacctggaattccagccctgaagccctgtgatgactccccttagctgtggtcagggccctcagcccagctgggcagcagcaggatgcagatccggttattaagagccgagctggtggttcccctctggcaattcatcaggcagtggccccctgggagtgatggatggggacaaatggaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaagaaactggtgggttagggccttggtccaggagccagttgagcca

SEQ ID NO: 30182 - DNA, 1806 bp, Homo sapiens
cctttcatctctgcaactccttcctccctgggcctcccttctggagaagggccagagaatgtcgtcccagccagcagggaaccagacctcccccggggccacagaggactactcctatggcagctggtacatcgatgagccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaa

SEQ ID NO: 30183 - DNA, 2324 bp, Homo sapiens
atgaatgaatgaaggggccttattcccccatctagaaagtgggactgactccacctccttgatttatggaatacagctgggaggtaatgggggtgcaggggctgagcaactccctcctgccctgtccttgcctctgtgctagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaagaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgag

SEQ ID NO: 30184 - DNA, 993 bp, Homo sapiens
atggggaagattgatgtggacaagatcctctttttcaatcaagaaatcaggctgtggcagcttataatggcaacccctgaagaaaacagcaatccccatgacagagcaacaccccagctgccagcacagctgcaggagcttgagcatcgggtggcccggagacggctgtcccaggcccgccaccgagccaccctggcagcgctcttcaacaacctcaggaagacagtgtactctcagtctgatctcatagcctcaaagtggcaggttctgaataaggcaaagagtcatattccagaactggagcaaaccctggataatttgctgaagctgaaagcatccttcaacctggaagatgggcatgcaagcagcttagaggaggtcaagaaagaatatgccagcatgtattctggaaatgacagttttcctcagaatggttcctccccttggtatctcaacttttacaaacagacgatggaccttctgactggcagcgggatcattaccccgcaggaggcggcgctgcccatcgtctccgcggccatctcccacctgtggcagaacctctcggaggagaggaaggccagcctccggcaggcctgggcgcagaagcaccgcggccctgcgaccctggcggaggcctgccgagagccggcctgtgccgagggcagcgtgaaggacagcggcgtggacagccagggggccagctgctcgctggtctccacgcccgaggagatcctttttgaggatgcctttgatgtggcaagcttcctggacaaaagtgaggttccgagtacatctagctccagttcagtgcttgccagctgcaacccagaaaacccagaggagaagtttcagctctatatgcagatcatcaacttttttaaaggccttagctgtgcaaacactcaagtaaagcaggaagcatcctttcccgttgatgaagagatgatcatgttgcagtgcacagagacctttgacgatgaagatttgtaa

SEQ ID NO: 30185 - DNA, 1426 bp, Homo sapiens
tggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacgaggtggga

SEQ ID NO: 30186 - DNA, 2053 bp, Homo sapiens
gcgccgccgcgggtggccgcgcgggtgaagccggaagcagcagccaggagggcggggccgcgtagggcccactggccagggagggcgccgcgcggaggcgcggggcgtgtctcctgtcaaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccgatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagcagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaatgtggtgtttacaatgtataaaagagaagaa

SEQ ID NO: 30187 - DNA, 1835 bp, Homo sapiens
gggccgcgtagggcccactggccagggagggcgccgcgcggaggcgcggggcgtgtctcctgtcaaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccgatgtaccccagagctggccctcctgcctctgtcatggcctcatcagtttcctggggttcttgctgctgttggtcaccttccccatttctggctggtttgccctgaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagcagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaatgtggtgtttacaatgt

SEQ ID NO: 30188 - DNA, 984 bp, Homo sapiens
atgctcggcaggtctgggtaccgggcgctgcccctgggtgattttgaccgcttccagcagtcgagcttcggctttctgggctcgcagaagggctgcttgtccccggagcggggcggcgtggggacaggggccgatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtag

SEQ ID NO: 30189 - DNA, 1448 bp, Homo sapiens
aaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccggctaaggcatcatcttcataaggactcctggaaagcacacttctggggctgatggtataggaggaatgtgttttgccagcagtattcagtgcatgtttacagatgcccaggtgctcctggctccatgccagatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttca

SEQ ID NO: 30190 - DNA, 1833 bp, Homo sapiens
tgggttttaaagacacgcccagagcggggaggaggtagaggcggagagctgcagacctaccgctgacttacgatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaa

SEQ ID NO: 30191 - DNA, 1849 bp, Homo sapiens
gcggggccgcgtagggcccactggccagggagggcgccgcgcggaggcgcggggcgtgtctcctgtcaaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccgatgtaccccagagctggccctcctgcctctgtcatggcctcatcagtttcctggggttcttgctgctgttggtcaccttccccatttctggctggtttgccctgaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaatgtggtgtttacaatgtataaaagagaagaa

SEQ ID NO: 30192 - DNA, 1278 bp, Homo sapiens
ggcttctgggagcgaccgctccgctcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctgggaacaaggaagcagattttcctgattctggctctagcttccctgccaagattttggtttttatttttttatttgaactttagtcgtgtaataaactcaccagtggcaaaccagaaa

SEQ ID NO: 30193 - DNA, 1049 bp, Homo sapiens
tcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctgggaacaaggaagcagattttcctgattctggctctagcttccctgcc

SEQ ID NO: 30194 - DNA, 2121 bp, Homo sapiens
tatacaaggtgcatagaagtgttttatgaaatataaatgctatagaaaattacacagcaatattttacaggaagcaataccaccagatggtcatattctttcaagttttttctgtgaacaaaggcagtctgaactcataaaagaaatctttttgtttatgttatcaggcttccctcaccagggtaactaccccttagggagttcactaaagagaaggaatgtctttcactctctcatactttctcctctcccctctcccaagcacatctgagttgctgcctgttcttcacacttagctccaaacccatgaaaaattgccaagtataaaagcttctcaagaatgagatggattctagggtgtcttcacctgagaagcaagataaagagaatttcgtgggtgtcaacaataaacggcttggtgtatgtggctggatcctgttttccctctctttcctgttggtgatcattaccttccccatctccatatggatgtgcttgaagatcattaaggagtatgaacgtgctgttgtattccgtctgggacgcatccaagctgacaaagccaaggggccaggtttgatcctggtcctgccatgcatagatgtgtttgtcaaagttgacctccgaacagttacttgcaacattcctccacaagagatcctcaccagagactccgtaactactcaggtagatggagttgtctattacagaatctatagtgctgtctcagcagtggctaatgtcaacgatgtccatcaagcaacatttctgctggctcaaaccactctgagaaatgtcttagggacacagaccttgtcccagatcttagctggacgagaagagatcgcccatagcatccagactttacttgatgatgccaccgaactgtgggggatccgggtggcccgagtggaaatcaaagatgttcggattcccgtgcagttgcagagatccatggcagccgaggctgaggccacccgggaagcgagagccaaggtccttgcagctgaaggagaaatgaatgcttccaaatccctgaagtcagcctccatggtgctggctgagtctcccatagctctccagctgcgctacctgcagaccttgagcacggtagccaccgagaagaattctacgattgtgtttcctctgcccatgaatatactagagggcattggtggcgtcagctatgataaccacaagaagcttccaaataaagcctgaggtcctcttgcggtagtcagctattgcatagagagtggtgtctattcctatggagaagccagtagttagaaacggtgagaattccaacactgttcatgtaacagtaactccatagatggaagagcattggcaggaaaaagctctagaggctatacagagaagaaaaaaagagcaaaaatgagacctgtatattacttttatttttaggaccataatcaactttgtaatattcttatataattaattagtggtggtctccgactttatagcaggaactttctggtagtatgagaagaaatcattgggtgactatgactaatgtttcagaattactttttaattgttttaaaaagcactccagataatttatagagtaacataggcctcatatttacactatatgttcgctttataattccgaagttgttatttgctaaatctccaatggttgcaatcaaaccccacaatgctgaaaacagagattgattttgatgttaagaacaaaagaagtatggaaacttccaggctcaaacatgtcccccgtgccacaaggcaaactgcgatgagctcacagtccaggtctcttgctgtgtgtcctgcagggagtggccaactctccaccttccagcaccattatcagagggtgggaaaaggcacatgaaagtggccagctcctgtcaatttatttgcttacaagggagaatgcttggaaaggttgcattggttgaaaccactgaggagcatcaccctggggatttcatgttttcactctgttcttagtcccaggagccacaggtaatcgagaatgtttgtgaactctatccacatcccctcccccacctgccaaataacctgttcaaaacaaagaaggcatagaatataaatgaatttcaaaagtta

SEQ ID NO: 30195 - DNA, 1997 bp, Homo sapiens
aaagagaaggaatgtctttcactctctcatactttctcctctcccctctcccaagcacatctgagttgctgcctgttcttcacacttagctccaaacccatgaaaaattgccaagtataaaagcttctcaagaatgagatggattctagggtgtcttcacctgagaagcaagataaagagaatttcgtggcacgtctattacctaatggagctgagcctcatgtgcacgtgtaatgatgcaagggcttgatgaactccagaggcgagcttgtaggtgtcaacaataaacggcttggtgtatgtggctggatcctgttttccctctctttcctgttggtgatcattaccttccccatctccatatggatgtgcttgaagatcattaaggagtatgaacgtgctgttgtattccgtctgggacgcatccaagctgacaaagccaaggggccaggtttgatcctggtcctgccatgcatagatgtgtttgtcaaagttgacctccgaacagttacttgcaacattcctccacaagagatcctcaccagagactccgtaactactcaggtagatggagttgtctattacagaatctatagtgctgtctcagcagtggctaatgtcaacgatgtccatcaagcaacatttctgctggctcaaaccactctgagaaatgtcttagggacacagaccttgtcccagatcttagctggacgagaagagatcgcccatagcatccagactttacttgatgatgccaccgaactgtgggggatccgggtggcccgagtggaaatcaaagatgttcggattcccgtgcagttgcagagatccatggcagccgaggctgaggccacccgggaagcgagagccaaggtccttgcagctgaaggagaaatgaatgcttccaaatccctgaagtcagcctccatggtgctggctgagtctcccatagctctccagctgcgctacctgcagaccttgagcacggtagccaccgagaagaattctacgattgtgtttcctctgcccatgaatatactagagggcattggtggcgtcagctatgataaccacaagaagcttccaaataaagcctgaggtcctcttgcggtagtcagctattgcatagagagtggtgtctattcctatggagaagccagtagttagaaacggtgagaattccaacactgttcatgtaacagtaactccatagatggaagagcattggcaggaaaaagctctagaggctatacagagaagaaaaaaagagcaaaaatgagacctgtatattacttttatttttaggaccataatcaactttgtaatattcttatataattaattagtggtggtctccgactttatagcaggaactttctggtagtatgagaagaaatcattgggtgactatgactaatgtttcagaattactttttaattgttttaaaaagcactccagataatttatagagtaacataggcctcatatttacactatatgttcgctttataattccgaagttgttatttgctaaatctccaatggttgcaatcaaaccccacaatgctgaaaacagagattgattttgatgttaagaacaaaagaagtatggaaacttccaggctcaaacatgtcccccgtgccacaaggcaaactgcgatgagctcacagtccaggtctcttgctgtgtgtcctgcagggagtggccaactctccaccttccagcaccattatcagagggtgggaaaaggcacatgaaagtggccagctcctgtcaatttatttgcttacaagggagaatgcttggaaaggttgcattggttgaaaccactgaggagcatcaccctggggatttcatgttttcactctgttcttagtcccaggagccacaggtaatcgagaatgtttgtgaactctatccacatcccctcccccacctgccaaataacctgttcaaaacaaagaaggcatagaatataaatgaatttcaaaagtt

SEQ ID NO: 30196 - DNA, 3377 bp, Homo sapiens
gatcctcccgccgagcgagcggcgtcgtagccgccgcgctcgccgaggccctgcgttgcgggctcccggccgccggcgaaagcatggcccggcccgtgcagctggcgccgggctcgctggcgctagtgctgtgccggctggaggcgcagaaggcggcgggggccgcggaggagcctggtgggcgcgcggtgttccgcgctttccgtcgcgccaacgcgcgctgcttctggaacgcgcggctggcgcgcgccgcctcgcggctggccttccagggctggctgcggcggggggtgctgctggtgcgcgcgccccccgcctgcctgcaggtgctgcgcgatgcctggcggcgccgggccctgcggccgccgcgcggcttccgcatcagggcggtgggtgatgtctttccagtgcaaatgaatccaataactcaatctcagttcgtacctttgggtgaagttctttgctgtgctatatctgatatgaatacagctcagattgtagtaacgcaggaatcacttttggagcgtttgatgaaacattacccaggcattgcaattccatcggaagatattctttataccactctgggaacgctgattaaagaaaggaagatttatcacactggagaaggatacttcatagttactcctcagacttacttcattacaaatacaaccacccaggaaaataagagaatgctgccatcagatgaaagtcgcctgatgccagcttccatgacatatctggtgagcatggagagctgtgcagagtcagcccaagagaatgctgcccccatatcccactgtcagtcttgccagtgtttccgggacatgcacactcaggatgttcaggaagcaccagttgctgcagaagtgactaggaagagtcacagaggtcttggggaatccgtatcttgggtacagaatggggcagtttcagtgtctgcggagcaccacatttgtgagagcaccaaacctttaccatacacaagagataaagaaaaaggcaagaagtttggttttagtctcttatggcgcagcttatctagaaaggagaagcccaaaacagaacacagcagtttctctgctcagttcccacctgaagaatggcccgtccgagatgaagatgacttggacaatatccctcgagatgttgaacatgagataatcaaacgaattaaccccattttgactgttgacaatttaatcaaacacactgtcctaatgcaaaaatacgaagaacagaaaaaatataatagccagggcacttccactgacatgctgacaatcgggcataagtatccttcaaaagagggggttaagaaaaggcagggtctgtctgcaaaacctcaagggcagggccattctcgaagggatagacacaaagccaggaatcagggaagtgagtttcagccaggaagcattagactggagaaacaccccaagctccctgctacacagcccatccccagaattaaaagcccaaatgaaatggtaggtcagaaaccacttggtgagattacaacagtgctaggttcccatttgatttacaaaaagcgaatcagtaatcctttccagggtttgtctcaccgaggaagcacaatatccaaagggcacaaaattcagaagacgagtgatctgaaacccagccagactggaccaaaggaaaagcctttccaaaagcctaggtccttggattcctcaagaatctttgatggtaaagccaaagagccatatgctgaacaacctaatgataaaatggaagcagaatccatttacataaatgaccctactgtcaaacccatcaatgatgacttcagaggtcacctcttcagtcaccctcaacagagcatgttgcaaaatgatggtaaatgctgtccctttatggaaagcatgttgagatatgaagtgtatggtggagaaaatgaggtaattcctgaagtcttgaggaaaagtcattcccactttgacaaattaggggagaccaaacagactccgcatagtctgccatcacgaggtgcctccttttcagaccgaacaccctctgcttgtagattagtggataacacaatacaccagtttcaaaatcttggccttttggattacccagttggcgtgaaccctttaagacaagctgcaagacaagacaaagactcagaagaattattgagaaaaggatttgtccaggatgcagagactacaagcctagaaaatgaacagctttctaacgatgaccaggccttgtatcagaatgaagtggaagatgatgatggtgcctgtagttcattatatctagaggaggatgacatttctgagaatgacgacttacgtcaaatgctgcctggccacagtcagtattccttcacaggtggaagccagggaaatcatttaggaaaacaaaaagtgattgagagatctctgaccgagtacaacagcacaatggagagggttgagtctcaggtgcttaaaagaaatgaatgctacaaacccactgggctgcatgctaccccaggtgaaagccaagaacctaacctctctgctgaaagttgtggcctaaattcaggggcccagtttggttttaactacgaagaagaacccagtgttgctaaatgtgtacaggcctcagcacctgctgatgaaagaatctttgattactatagcgcaagaaaagccagttttgaagctgaagtcatacaagacactattggtgacacaggaaagaagccagctagctggagtcagagtcctcagaatcaggaaatgagaaaacatttcccacaaaagttccaacttttcaacacttcacatatgccagtgttggctcaggatgtccaatatgaacacagtcacttggaagggacagaaaatcacagcatggcaggagatagtggaatagattctccacggacacagagtctgggatctaataattcagtcattttggatggactaaaaagaagacagaattttctgcaaaatgtcgaaggcacaaagagcagtcaaccactcacatctaattccttactaccgctaactccagtcataaacgtttaattttcttttggaaacctacttttttctttataaaaaggtagagcattattacagaatctttcaatcatgtaagaattgagtatataagaattgtctaaaggcaagcatatctatactattaaccacattacacattttgttctaattactggctttttttcctcttttggtgtcttaaggctttttgaagcttattttactgtgagtttattgggagtatatagattattttcgattaaaaagtggaattattggtccccttccaattgtaattatcttgaatttttatacattagtttctcaaatatatagaatgccaattta

SEQ ID NO: 30197 - DNA, 935 bp, Homo sapiens
atggcccggcccgtgcagctggcgccgggctcgctggcgctagtgctgtgccggctggaggcgcagaaggcggcgggggccgcggaggagcctggtgggcgcgcggtgttccgcgctttccgtcgcgccaacgcgcgctgcttctggaacgcgcggctggcgcgcgccgcctcgcggctggccttccagggctggctgcggcggggggtgctgctggtgcgcgcgccccccgcctgcctgcaggtgctgcgcgatgcctggcggcgccgggccctgcggccgccgcgcggcttccgcatcagggcggtgggtgatgtctttccagtgcaaatgaatccaataactcaatctcagttcgtacctttgggtgaagttctttgctgtgctatatctgatatgaatacagctcagattgtagtaacgcaggaatcacttttggagcgtttgatgaaacattacccaggacacagagtctgggatctaataattcagtcattttggatggactaaaaagaagacagaattttctgcaaaatgtcgaaggcacaaagagcagtcaaccactcacatctaattccttactaccgctaactccagtcataaacgtttaattttcttttggaaacctacttttttctttataaaaaggtagagcattattacagaatctttcaatcatgtaagaattgagtatataagaattgtctaaaggcaagcatatctatactattaaccacattacacattttgttctaattactggctttttttcctcttttggtgtcttaaggctttttgaagcttattttactgtgagtttattgggagtatatagattattttcgattaaaaagtggaattattggtccccttccaattgtaattatcttgaatttttatacattagtttctcaaatatatagaatgccaattta

SEQ ID NO: 30198 - DNA, 1135 bp, Homo sapiens
atggcccggcccgtgcagctggcgccgggctcgctggcgctagtgctgtgccggctggaggcgcagaaggcggcgggggccgcggaggagcctggtgggcgcgcggtgttccgcgctttccgtcgcgccaacgcgcgctgcttctggaacgcgcggctggcgcgcgccgcctcgcggctggccttccagggctggctgcggcggggggtgctgctggtgcgcgcgccccccgcctgcctgcaggtgctgcgcgatgcctggcggcgccgggccctgcggccgccgcgcggcttccgcatcagggcggtgggtgatgtctttccagtgcaaatgaatccaataactcaatctcagttcgtacctttgggtgaagttctttgctgtgctatatctgatatgaatacagctcagattgtagtaacgcaggaatcacttttggagcgtttgatgaaacattacccaggcattgcaattccatcggaagatattctttataccactctgggaacgctgattaaagaaaggaagatttatcacactggagaaggatacttcatagttactcctcagacttacttcattacaaatacaaccacccaggaaaataagagaatgctgccatcagatgaaagtcgcctgatgccagcttccatgacatatctggacacagagtctgggatctaataattcagtcattttggatggactaaaaagaagacagaattttctgcaaaatgtcgaaggcacaaagagcagtcaaccactcacatctaattccttactaccgctaactccagtcataaacgtttaattttcttttggaaacctacttttttctttataaaaaggtagagcattattacagaatctttcaatcatgtaagaattgagtatataagaattgtctaaaggcaagcatatctatactattaaccacattacacattttgttctaattactggctttttttcctcttttggtgtcttaaggctttttgaagcttattttactgtgagtttattgggagtatatagattattttcgattaaaaagtggaattattggtccccttccaattgtaattatcttgaatttttatacattagtttctcaaatatatagaatgccaattta

SEQ ID NO: 30199 - DNA, 3281 bp, Homo sapiens
gatcctcccgccgagcgagcggcgtcgtagccgccgcgctcgccgaggccctgcgttgcgggctcccggccgccggcgaaagcatggcccggcccgtgcagctggcgccgggctcgctggcgctagtgctgtgccggctggaggcgcagaaggcggcgggggccgcggaggagcctggtgggcgcgcggtgttccgcgctttccgtcgcgccaacgcgcgctgcttctggaacgcgcggctggcgcgcgccgcctcgcggctggccttccagggctggctgcggcggggggtgctgctggtgcgcgcgccccccgcctgcctgcaggtgctgcgcgatgcctggcggcgccgggccctgcggccgccgcgcggcttccgcatcagggcggtgggtgatgtctttccagtgcaaatgaatccaataactcaatctcagttcgtacctttgggtgaagttctttgctgtgctatatctgatatgaatacagctcagattgtagtaacgcaggaatcacttttggagcgtttgatgaaacattacccaggcattgcaattccatcggaagatattctttataccactctgggaacgctgattaaagaaaggaagatttatcacactggagaaggatacttcatagttactcctcagacttacttcattacaaatacaaccacccaggaaaataagagaatgctgccatcagatgaaagtcgcctgatgccagcttccatgacatatctggtgagcatggagagctgtgcagagtcagcccaagagaatgctgcccccatatcccactgtcagtcttgccagtgtttccgggacatgcacactcaggatgttcaggaagcaccagttgctgcagaagtgactaggaagagtcacagaggtcttggggaatccgtatcttgggtacagaatggggcagtttcagtgtctgcggagcaccacatttgtgagagcaccaaacctttaccatacacaagagataaagaaaaaggcaagaagtttggttttagtctcttatggcgcagcttatctagaaaggagaagcccaaaacagaacacagcagtttctctgctcagttcccacctgaagaatggcccgtccgagatgaagatgacttggacaatatccctcgagatgttgaacatgagataatcaaacgaattaaccccattttgactgttgacaatttaatcaaacacactgtcctaatgcaaaaatacgaagaacagaaaaaatataatagccagggcacttccactgacatgctgacaatcgggcataagtatccttcaaaagagggggttaagaaaaggcagggtctgtctgcaaaacctcaagggcagggccattctcgaagggatagacacaaagccaggaatcagggaagtgagtttcagccaggaagcattagactggagaaacaccccaagctccctgctacacagcccatccccagaattaaaagcccaaatgaaatggtaggtcagaaaccacttggtgagattacaacagtgctaggttcccatttgatttacaaaaagcgaatcagtaatcctttccagggtttgtctcaccgaggaagcacaatatccaaagggcacaaaattcagaagacgagtgatctgaaacccagccagactggaccaaaggaaaagcctttccaaaagcctaggtccttggattcctcaagaatctttgatggtaaagccaaagagccatatgctgaacaacctaatgataaaatggaagcagaatccatttacataaatgaccctactgtcaaacccatcaatgatgacttcagaggtcacctcttcagtcaccctcaacagagcatgttgcaaaatgatggtaaatgctgtccctttatggaaagcatgttgagatatgaagtgtatggtggagaaaatgaggtaattcctgaagtcttgaggaaaagtcattcccactttgacaaattaggggagaccaaacagactccgcatagtctgccatcacgaggtgcctccttttcagaccgaacaccctctgcttgtagattagtggataacacaatacaccagtttcaaaatcttggccttttggattacccagttggcgtgaaccctttaagacaagctgcaagacaagacaaagactcagaagaattattgagaaaaggatttgtccaggatgcagagactacaagcctagaaaatgaacagctttctaacgatgaccaggccttgtatcagaatgaagtggaagatgatgatggtgcctgtagttcattatatctagaggaggatgacatttctgagaatgacgacttacgtcaaatgctgcctggccacagtcagtattccttcacaggtggaagccagggaaatcatttaggaaaacaaaaagtgattgagagatctctgaccgagtacaacagcacaatggagagggttgagtctcaggtgcttaaaagaaatgaatgctacaaacccactgggctgcatgctaccccaggtgaaagccaagaacctaacctctctgctgaaagttgtggcctaaattcaggggcccagtttggttttaactacgaagaagaacccagtgttgctaaatgtgtacaggcctcagcacctgctgatgaaagaatctttgattactatagcgcaagaaaagccagttttgaagctgaagtcatacaagacactattggtgacacaggaaagaagccagctagctggagtcagagtcctcagaatcaggaaatgagaaaacatttcccacaaaagttccaacttttcaacacttcacatatgccagtgttggctcaggatgtccaatatgaacacagtcacttggaagggacagaaaatcacagcatggcaggagatagtggaatagattctccacggacacagagtctgggatctaataattcagtcattttggatggactaaaaagaagacagaattttctgcaaaatgtcgaaggcacaaagagcagtcaaccactcacatctaattccttactaccgctaactccagtcataaacgtttaattttcttttggaaacctacttttttctttataaaaaggagatggggttttgccatgttgcgcaactaatgaagtccatctaattttgccactggatgcattatgacactctccctgttttaaaggaatgtattaaatgaatcaagctcattatgaaaccagtaaaattttctcctatgaaactcatcatataacacagacattaaagatgggaatatgtgcgattaaa

SEQ ID NO: 30200 - DNA, 3111 bp, Homo sapiens
cttccagggctggctgcggcggggggtgctgctggtgcgcgcgccccccgcctgcctgcaggtgctgcgcgatgcctggcggcgccgggccctgcggccgccgcgcggcttccgcatcagggcggtgggtgatgtctttccagtgcaaatgaatccaataactcaatctcagttcgtacctttgggtgaagttctttgctgtgctatatctgatatgaatacagctcagattgtagtaacgcaggaatcacttttggagcgtttgatgaaacattacccaggcattgcaattccatcggaagatattctttataccactctgggaacgctgattaaagaaaggaagatttatcacactggagaaggatacttcatagttactcctcagacttacttcattacaaatacaaccacccaggaaaataagagaatgctgccatcagatgaaagtcgcctgatgccagcttccatgacatatctggtgagcatggagagctgtgcagagtcagcccaagagaatgctgcccccatatcccactgtcagtcttgccagtgtttccgggacatgcacactcaggatgttcaggaagcaccagttgctgcagaagtgactaggaagagtcacagaggtcttggggaatccgtatcttgggtacagaatggggcagtttcagtgtctgcggagcaccacatttgtgagagcaccaaacctttaccatacacaagagataaagaaaaaggcaagaagtttggttttagtctcttatggcgcagcttatctagaaaggagaagcccaaaacagaacacagcagtttctctgctcagttcccacctgaagaatggcccgtccgagatgaagatgacttggacaatatccctcgagatgttgaacatgagataatcaaacgaattaaccccattttgactgttgacaatttaatcaaacacactgtcctaatgcaaaaatacgaagaacagaaaaaatataatagccagggcacttccactgacatgctgacaatcgggcataagtatccttcaaaagagggggttaagaaaaggcagggtctgtctgcaaaacctcaagggcagggccattctcgaagggatagacacaaagccaggaatcagggaagtgagtttcagccaggaagcattagactggagaaacaccccaagctccctgctacacagcccatccccagaattaaaagcccaaatgaaatggtaggtcagaaaccacttggtgagattacaacagtgctaggttcccatttgatttacaaaaagcgaatcagtaatcctttccagggtttgtctcaccgaggaagcacaatatccaaagggcacaaaattcagaagacgagtgatctgaaacccagccagactggaccaaaggaaaagcctttccaaaagcctaggtccttggattcctcaagaatctttgatggtaaagccaaagagccatatgctgaacaacctaatgataaaatggaagcagaatccatttacataaatgaccctactgtcaaacccatcaatgatgacttcagaggtcacctcttcagtcaccctcaacagagcatgttgcaaaatgatggtaaatgctgtccctttatggaaagcatgttgagatatgaagtgtatggtggagaaaatgaggtaattcctgaagtcttgaggaaaagtcattcccactttgacaaattaggggagaccaaacagactccgcatagtctgccatcacgaggtgcctccttttcagaccgaacaccctctgcttgtagattagtggataacacaatacaccagtttcaaaatcttggccttttggattacccagttggcgtgaaccctttaagacaagctgcaagacaagacaaagactcagaagaattattgagaaaaggatttgtccaggatgcagagactacaagcctagaaaatgaacagctttctaacgatgaccaggccttgtatcagaatgaagtggaagatgatgatggtgcctgtagttcattatatctagaggaggatgacatttctgagaatgacgacttacgtcaaatgctgcctggccacagtcagtattccttcacaggtggaagccagggaaatcatttaggaaaacaaaaagtgattgagagatctctgaccgagtacaacagcacaatggagagggttgagtctcaggtgcttaaaagaaatgaatgctacaaacccactgggctgcatgctaccccaggtgaaagccaagaacctaacctctctgctgaaagttgtggcctaaattcaggggcccagtttggttttaactacgaagaagaacccagtgttgctaaatgtgtacaggcctcagcacctgctgatgaaagaatctttgattactatagcgcaagaaaagccagttttgaagctgaagtcatacaagacactattggtgacacaggaaagaagccagctagctggagtcagagtcctcagaatcaggaaatgagaaaacatttcccacaaaagttccaacttttcaacacttcacatatgccagtgttggctcaggatgtccaatatgaacacagtcacttggaagggacagaaaatcacagcatggcaggagatagtggaatagattctccacggacacagagtctgggatctaataattcagtcattttggatggactaaaaagaagacagaattttctgcaaaatgtcgaaggcacaaagagcagtcaaccactcacatctaattccttactaccgctaactccagtcataaacgtttaattttcttttggaaacctacttttttctttataaaaaggtagagcattattacagaatctttcaatcatgtaagaattgagtatataagaattgtctaaaggcaagcatatctatactattaaccacattacacattttgttctaattactggctttttttcctcttttggtgtcttaaggctttttgaagcttattttactgtgagtttattgggagtatatagattattttcgattaaaaagtggaattattggtccccttccaattgtaattatcttgaatttttatacattagtttctcaaatatatagaatgccaattt

SEQ ID NO: 30201 - DNA, 10978 bp, Homo sapiens
atggtggagccagggcaagatttactgcttgctgctttgagtgagagtggaattagtccgaatgacctctttgatattgatggtggagatgcagggcttgcaactccaatgcctaccccgtcagttcagcagtcagtgccacttagtgcattagaactaggtttggagaccgaagcagcagttcctgttaaacaagaaccagagactgtacctactccagcactattaaatgtgaggcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctactgatgtaagcaatggtacagtaaagaaagagtcttctaataaagaaggagctagaatgtggataaacgacatgaagatgaggagtttttccccaaccatgaaggttcctgttgtaaaagaagatgatgaaccagaggaagaagatgaagaagaaatgggtcatgcagaaacctatgcagaatacatgccaataaaattaaaaattggcctacgtcatccagatgctgtagtggaaaccagctctttatccagtgttactcctcctgatgtttggtacaaaacatccatttctgaggaaaccattgataatggctggttatcagcattgcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttggttcattcgttaaataagtttaaatacggaaaaatttcttccaaacataatgggagtgtgaaaaagggtgttatttttgctacttactcttcacttattggtgaaagccagtctggcggcaagtataaaactaggttaaaacaacttctgcattggtgcggtgatgacttcgatggagtgatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcatcgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattgaaaaacattttcctgctccagacaggaaaaaactttatagtttactaggaatcgatttgacagctccaagtaacaacagttcgccaagagatagtccttgtaaagaaaataaaataaagaagcggaaaggtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatgatccctggttaattagaaaagaccacaagaaaaacaaagagaaaaaaaagaagaaaagtatagatccagattctattcaaagtgccttattagcatcaggtcttggatcaaaacgacctagtttttcatctacaccagttatctcacctgctcctaacagtacaccagctaacagtaacaccaacagtaacagtagccttataacaagtcaggatgctgtggaaagggctcagcagatgaagaaagacctgcttgataagctagaaaaattagctgaagacctcccccctaataccctggatgaacttatcgatgaacttggtggccctgagaacgttgctgagatgactggccgcaagggacgggttgtgagcaatgatgatggaagcatatcttatgagtcaagatctgaacttgatgtgcctgtggaaatactaaacatcacagaaaaacaacgatttatggatggagataagaatattgctatcatctcagaagctgccagctcgggtatttcattacaagcagataggagagctaaaaatcaaaggcgaagagttcatatgactttagaattaccttggagcgctgatagagcaattcaacagttcggacgtactcatagatcaaaccaagttactgctcctgagtatgtctttctgatatctgaactggcaggagaacaaagatttgcatctattgttgctaaaagacttgagagtttgggggcacttacacatggtgatagaagggcaacagaatctagagatctgagcaggttcaactttgataataagtatggaagaaatgctttagaaattgtcatgaaatccattgtaaacttggattctcctatggtatcaccacctccagactatcctggagaattttttaaagatgttcgacaaggactgataggcgttggcctgataaatgtagaagatcgctcgggaattcttactctcgataaagattataacaacataggaaaattcttaaatagaattttaggcatggaggtgcatcagcagaatgcgttatttcagtattttgcggacacacttactgcagttgttcaaaatgccaaaaaaaatggaagatatgatatgggaatcttagatcttggttctggagatgaaaaagtgcggaaaagtgatgttaaaaagtttctgactccaggatattcaacctctggccacgtagaattatacacaattagtgtagagaggggaatgtcatgggaggaagctaccaagatttgggctgagctgacaggaccagacgatggcttttacttgtcattgcaaataaggaacaacaagaaaactgccatcttagttaaagaagtgaatcctaaaaagaaacttttcttagtttatcgaccaaatactgggaagcagctcaaattagaaatttatgctgatctaaaaaagaaatataagaaggtcgtctcagatgatgccctgatgcactggttagatcagtataattcatctgcagatacttgtactcatgcttattggcgcggcaattgcaaaaaagcaagcttggggctagtttgtgaaataggtcttcgttgccgtacatattatgtattatgtggttcagtgctgagtgtctggacaaaagttgagggtgttctagcatctgtcagtggcacaaacgtgaagatgcagatcgtgcggctaagaacggaagatgggcaacggattgtaggtttgatcattccggcaaattgtgtgtctcctcttgtaaatctcctatcaacttcagaccagtctcaacagcttgcggtccaacagaaacagctatggcaacagcatcaccctcagagcatcaccaacttgagcaacgcatgaagaacagacaggtttcaacatggatggatctgaaatgctgttgaagcatatcatttgcataaaaatcagggacagtttccaaagaattatatatttttttcagttgtgctctctagttagtttttttgggagtaaggacaaacctggaatagatagcaaaactgaaaatcagcagtgctgatggtggtacatatgtctttcctttagcttctcccctgataattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaataggtttattaaagcatgaaatgaaaggttgcatatcatgcattcaggttattttctaatttttgttctgacagtgcatgtctttggaagcatgctgaaacaagattaacacaggagtcgagtaacagagagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagttttgtttcgcctataatagatgtttataaaaacaagtgaggggacagttggtctttttatcttttctttctttttctttcttttctttttttctttttttttttttttttttttttttttgcttccacaggttgcactattgaaaaatcgagattgtataaacctggtaaaaagctgcaagatgccaaaatcttgtagatgtcaaataaaaagttattatactaacaagaagtggactcttgtttaggccctcactggtgaccttcagaagtagtctgtgacggggactcagcagaatttgtgtgttgtctcagcattccaggtagccttatagtttggcttaaaacttatccctaaaatgtaagatggcattgagggaaagggtataatgatagtacttctgaatgttttttaagttgaattgtttgtaaacttcttgcagaattgggtgagatgtgtgttaaaactgacaaacctggctgaaagcttagggcgttcatcctcttgtgtctcctttagcctgagtttggttatgtcaagcttaccgtaagttttcttaggatttatttattcttggtgcctaaaagaataaattgaaagtactttctgttctttggcacattttgcccagcggatgcaacttctatcctcagtccagttcatatatctcaggcagtgatccattttgtatcagccagtttcccttgttagggccgctagacccggctggcagccaagagcagcactctccccaccttcagcagaacttctcagctcatgtgtgtgtttttaaaagcagtaggcagcttccatcagcaatggaagtgtcccccactccagtggtggaggtgcagtcgctggacctgaggaagtggggaagcattacaaaccctcctgcagtaagaatggcagagttgggaaggatcttctctcgcaggctgttggcccaactcctcttttctgtgtatgagggcatcttagttttttatggcgttttcaaagcagcatatgaggattcttagcatgcagctaagtgacaacccccatggcctatgatgtaatgtttgctctggactagccatcttgataaataggagtgtatgtatcttaggttctttgtagaacagctatttttttttctcattaaaaaggcctctgaaagccctctcaaaatggacctcacaaaggcaaccagtgtgaatggatgggagctggggtgctgcatgcccaggctggtcatggtgtgtgcagcacccagagagttgcacccaccccttcttcaggtggacatccgacctttacactgtggtcttgcaaaaatcagcgagttagtttggccgccctgtgaagcttcagcattcaaggtcctcttctgttaaaacccaactcgtagccgggcgtggtggctcactcctataatcccagcacttcgggaggccaaggcaggtgcatcacttgaggccaggagttcgagaccagcctggtccacatggcaaaaccccatctgtaccaaaaaatacaaaaaatttgccgctgacttctgtaaaataggtccattcattgcaggatctaaatgccacacctgaattcagaggccttgtttaattaaccccatgtccactttgcctctgcaatgcctttttctttttagcaatatggctctgagcacaaagatttggttggaaatcatgttcgtgttttcagagtttacagcgtcaattgtactgaaaaccacttccagagtctaaagcagctcagatgttatctctgggggaattagtgttcccctcatttagcaacctccataccacaaggtctctgtctgtagttactgggattatccagatacactatcaatgatacaaattcataggagtattaatgcatttctttaaacacaacttgattaagaagcaaatatgttaagcagttttctttttctgctgctaaattacagttagacacttcagtatcttctctttacatgtgtatataaattagtaagaacctgcatccaaagcaatgtagtgtgtgtatgtatctatatatatttattctaactcagcacttcagaagcctttttgagttacaacaatattttagtttgcctcatctgtagaggtaaaatttctatattaccaagctccagaggaatatgatattttacaggcacaattttctggctgtagtccctggggcattcatttgctggcctccatgggatgctgttagaacaattgttagccggcaagagaagaaaggctaccaggacagcatttataattgtagaatgggagccttcttccctctcccctccactttcattttagcatgagataaaaaaatagattggaaatgattgttgcatctcacttcatggaagtaggggcagaagttccctctggatccttttcttgacaagcagtcaagaggaaggtccccatacacatgtacctgtgtgatacttggtagtttctaagaatggtgctacataagcgttgctgttaggctgggatcctattaatgaacgtttgattagttcaggcctcccaatggcaaaggcagacaccgtggagatggacatttactgactccccttctgtgtggcttcggtctccctggctaacaccacacctgtgcgtactgcgctcggcccactttgctgcagaaacgtagcaagcgtttcatgtcagggctacagctgagagcaaaaactgcaaaaaaaaaaaaaaatgtctcattgaatgccagttgtctgatacaaatgcagtgtcttttaagtgacagaaacacacctaaatacctgcaactcaagctcgctagcattttttttttgagtacttgagataaaatccaaaacccaccctctaattttgtgctgtatttatatatatgtacataaatgtatatatagagaaatgttgagttcttctggattctgaatgtaaataattcttgtaaattgggactctgcccacctgtttctcccttttccctcttcccttcagctctatttattcttttcttgactttcccatatggggcatcttatgacttttttttttttttttttttaagaaaagtatggaaaacttttcatttagaaaagtatttgttcctgtattttagaattcagttttgcatctttgctgtagaattcctgttttgtgttaatgttttttactatgtcttattgtgttgtgtgcaatgcattgtactggggggatgcacttgagtgccatttctgatactgtcattgtatgactgctgatgctcgtttatgttgttctttggaagctatagtgagcctgatgttttcacattttaaaaaatgcttcctgagacttctttaagctcctctaacttcttcagtgcatttgggatcaaacttagctcttagatcagcaaacctgacttgcttctacttttgcaatttttcaggccttaccatatttcttatctctgtcttcccacctgataggaaaatcttgcagatttgaaacagtggtttctggcctgctgctgcagcaaattccctatgtttatttaagaagtcgggcctatgcttttaacctacaaatgatgagtaatttacttgcaatgaacacaggtagcctgctgctgtttataacctgttgaggatatttatagcaggcaggaggcaggcctagtgtgttattgacaggtgactttagagaatgtacattggccgggtgcggtggctcacgcctgtaatcccagcactttgggaggccgaggcgggcggatcatgaggtcaggagattgagaccatctcctggctaacacggtgaaaccccgtctctactaaaaatacaaaaaaaaaaaaaacttagccaggcgtggtggcgggtgcctgtagtcccagctactcaggaggctgaggcaggagaatggcatgaacctgggaggcagagcttgcagtgagcccagatcgcgccactgcactccagcctgggcaacagaccgagactccgtctcgaaaaaaaaaaaagagagagaatgtacattaaggaacaattgtcctccaaaagagagccaagcaactgctctggagcctcctaggctgactctgctggagggtgagacaagcagattcccattgcagcactggtccctggggtaccctgaacggctgtgctctccacccttgtatcggtgagtggatcttgtctacatcagccgtaagcctagaagcagagcgggatcgaggcgtttttaataattcgagttgggaagacccggatggttcatcaaaatgatggtgttgagcacccgggaggcagacattgggtatttgttcacaattttgcacctgtaagaaaatgttcctttataactttcaaggattgccgtgagcgtctttggggccttttcattcatgtacaagtttcattcattactattcaacttggtagacttggtgaaaaatgtaaaagcattctgtatttggatcagtcttgggaactaaatttgtcgtgaattggggcctgtcacagattgcctccagtgtgcatcctccacgcagaccctccttgctcagtctccctctggcgcccatggggaagccgtgctgtggttggcagtgcggccatctgggctgccgcaacgtggcagggcaccgtccagcaagactgccccttagtgcagggctaagcaaggaaaagaagaagcccaaaaaggcgggttctttttgatacttgtaattcaggcgtcctccagagtgaaggccactctgcaggcccctggtgagaacctgtctggcttttccactgcgggcccctaaccagtaccctgcccttgtggcccatttgtgcctgggcagatgtttctggccagcagacactgaaggcctttttgctgtgacagtatttatggcactgaagaggataaagaagcttgagccctctttctgactcccactttatggggcagagagagctttttttctacatagcacattgcagtctcaccgctatcagaaaaatatcctgttcatggtttatactgaatttgcaaactactgatatgatttttcaataaccacttgtatcttccatcatccatgagaggtgggaagaggtacactgtatctctgcaataaaactttggccaggttctacctcctctgagcaaaggatacttttctatgtaggtgtagatggttctcctttactaatctgacatggtgcatctggagacaacatctgatgggatccaaagacaacttgaaacaaaggtggatgtcagctcttggtgtgttttcatttggttctcttttttaaatctcccttttgttatcgctcctgttgtagcgtgtccatcagtgtgtgaagggtgcgccctgttccaatgatactgcattgctgcatccagcctttcgtgggagcacggtaccaagcgtccggaattgattatcccaatcatttttgatatgtaactgaaaaatttggtctcatgcaataaaaatgtactggctgcattttagcaaggtttatttactcttgcaagtaaaaacgatcaaccgtgaagcgtaacaaattctgtatttagtttttttttctgttgtggtggtttttgttttgttttttgtttttgtaagattctaaataaattaaatacgagtca

SEQ ID NO: 30202 - DNA, 10981 bp, Homo sapiens
atggtggagccagggcaagatttactgcttgctgctttgagtgagagtggaattagtccgaatgacctctttgatattgatggtggagatgcagggcttgcaactccaatgcctaccccgtcagttcagcagtcagtgccacttagtgcattagaactaggtttggagaccgaagcagcagttcctgttaaacaagaaccagagactgtacctactccagcactattaaatgtgaggcagcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctactgatgtaagcaatggtacagtaaagaaagagtcttctaataaagaaggagctagaatgtggataaacgacatgaagatgaggagtttttccccaaccatgaaggttcctgttgtaaaagaagatgatgaaccagaggaagaagatgaagaagaaatgggtcatgcagaaacctatgcagaatacatgccaataaaattaaaaattggcctacgtcatccagatgctgtagtggaaaccagctctttatccagtgttactcctcctgatgtttggtacaaaacatccatttctgaggaaaccattgataatggctggttatcagcattgcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttggttcattcgttaaataagtttaaatacggaaaaatttcttccaaacataatgggagtgtgaaaaagggtgttatttttgctacttactcttcacttattggtgaaagccagtctggcggcaagtataaaactaggttaaaacaacttctgcattggtgcggtgatgacttcgatggagtgatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcatcgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattgaaaaacattttcctgctccagacaggaaaaaactttatagtttactaggaatcgatttgacagctccaagtaacaacagttcgccaagagatagtccttgtaaagaaaataaaataaagaagcggaaaggtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatgatccctggttaattagaaaagaccacaagaaaaacaaagagaaaaaaaagaagaaaagtatagatccagattctattcaaagtgccttattagcatcaggtcttggatcaaaacgacctagtttttcatctacaccagttatctcacctgctcctaacagtacaccagctaacagtaacaccaacagtaacagtagccttataacaagtcaggatgctgtggaaagggctcagcagatgaagaaagacctgcttgataagctagaaaaattagctgaagacctcccccctaataccctggatgaacttatcgatgaacttggtggccctgagaacgttgctgagatgactggccgcaagggacgggttgtgagcaatgatgatggaagcatatcttatgagtcaagatctgaacttgatgtgcctgtggaaatactaaacatcacagaaaaacaacgatttatggatggagataagaatattgctatcatctcagaagctgccagctcgggtatttcattacaagcagataggagagctaaaaatcaaaggcgaagagttcatatgactttagaattaccttggagcgctgatagagcaattcaacagttcggacgtactcatagatcaaaccaagttactgctcctgagtatgtctttctgatatctgaactggcaggagaacaaagatttgcatctattgttgctaaaagacttgagagtttgggggcacttacacatggtgatagaagggcaacagaatctagagatctgagcaggttcaactttgataataagtatggaagaaatgctttagaaattgtcatgaaatccattgtaaacttggattctcctatggtatcaccacctccagactatcctggagaattttttaaagatgttcgacaaggactgataggcgttggcctgataaatgtagaagatcgctcgggaattcttactctcgataaagattataacaacataggaaaattcttaaatagaattttaggcatggaggtgcatcagcagaatgcgttatttcagtattttgcggacacacttactgcagttgttcaaaatgccaaaaaaaatggaagatatgatatgggaatcttagatcttggttctggagatgaaaaagtgcggaaaagtgatgttaaaaagtttctgactccaggatattcaacctctggccacgtagaattatacacaattagtgtagagaggggaatgtcatgggaggaagctaccaagatttgggctgagctgacaggaccagacgatggcttttacttgtcattgcaaataaggaacaacaagaaaactgccatcttagttaaagaagtgaatcctaaaaagaaacttttcttagtttatcgaccaaatactgggaagcagctcaaattagaaatttatgctgatctaaaaaagaaatataagaaggtcgtctcagatgatgccctgatgcactggttagatcagtataattcatctgcagatacttgtactcatgcttattggcgcggcaattgcaaaaaagcaagcttggggctagtttgtgaaataggtcttcgttgccgtacatattatgtattatgtggttcagtgctgagtgtctggacaaaagttgagggtgttctagcatctgtcagtggcacaaacgtgaagatgcagatcgtgcggctaagaacggaagatgggcaacggattgtaggtttgatcattccggcaaattgtgtgtctcctcttgtaaatctcctatcaacttcagaccagtctcaacagcttgcggtccaacagaaacagctatggcaacagcatcaccctcagagcatcaccaacttgagcaacgcatgaagaacagacaggtttcaacatggatggatctgaaatgctgttgaagcatatcatttgcataaaaatcagggacagtttccaaagaattatatatttttttcagttgtgctctctagttagtttttttgggagtaaggacaaacctggaatagatagcaaaactgaaaatcagcagtgctgatggtggtacatatgtctttcctttagcttctcccctgataattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaataggtttattaaagcatgaaatgaaaggttgcatatcatgcattcaggttattttctaatttttgttctgacagtgcatgtctttggaagcatgctgaaacaagattaacacaggagtcgagtaacagagagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagttttgtttcgcctataatagatgtttataaaaacaagtgaggggacagttggtctttttatcttttctttctttttctttcttttctttttttctttttttttttttttttttttttttttgcttccacaggttgcactattgaaaaatcgagattgtataaacctggtaaaaagctgcaagatgccaaaatcttgtagatgtcaaataaaaagttattatactaacaagaagtggactcttgtttaggccctcactggtgaccttcagaagtagtctgtgacggggactcagcagaatttgtgtgttgtctcagcattccaggtagccttatagtttggcttaaaacttatccctaaaatgtaagatggcattgagggaaagggtataatgatagtacttctgaatgttttttaagttgaattgtttgtaaacttcttgcagaattgggtgagatgtgtgttaaaactgacaaacctggctgaaagcttagggcgttcatcctcttgtgtctcctttagcctgagtttggttatgtcaagcttaccgtaagttttcttaggatttatttattcttggtgcctaaaagaataaattgaaagtactttctgttctttggcacattttgcccagcggatgcaacttctatcctcagtccagttcatatatctcaggcagtgatccattttgtatcagccagtttcccttgttagggccgctagacccggctggcagccaagagcagcactctccccaccttcagcagaacttctcagctcatgtgtgtgtttttaaaagcagtaggcagcttccatcagcaatggaagtgtcccccactccagtggtggaggtgcagtcgctggacctgaggaagtggggaagcattacaaaccctcctgcagtaagaatggcagagttgggaaggatcttctctcgcaggctgttggcccaactcctcttttctgtgtatgagggcatcttagttttttatggcgttttcaaagcagcatatgaggattcttagcatgcagctaagtgacaacccccatggcctatgatgtaatgtttgctctggactagccatcttgataaataggagtgtatgtatcttaggttctttgtagaacagctatttttttttctcattaaaaaggcctctgaaagccctctcaaaatggacctcacaaaggcaaccagtgtgaatggatgggagctggggtgctgcatgcccaggctggtcatggtgtgtgcagcacccagagagttgcacccaccccttcttcaggtggacatccgacctttacactgtggtcttgcaaaaatcagcgagttagtttggccgccctgtgaagcttcagcattcaaggtcctcttctgttaaaacccaactcgtagccgggcgtggtggctcactcctataatcccagcacttcgggaggccaaggcaggtgcatcacttgaggccaggagttcgagaccagcctggtccacatggcaaaaccccatctgtaccaaaaaatacaaaaaatttgccgctgacttctgtaaaataggtccattcattgcaggatctaaatgccacacctgaattcagaggccttgtttaattaaccccatgtccactttgcctctgcaatgcctttttctttttagcaatatggctctgagcacaaagatttggttggaaatcatgttcgtgttttcagagtttacagcgtcaattgtactgaaaaccacttccagagtctaaagcagctcagatgttatctctgggggaattagtgttcccctcatttagcaacctccataccacaaggtctctgtctgtagttactgggattatccagatacactatcaatgatacaaattcataggagtattaatgcatttctttaaacacaacttgattaagaagcaaatatgttaagcagttttctttttctgctgctaaattacagttagacacttcagtatcttctctttacatgtgtatataaattagtaagaacctgcatccaaagcaatgtagtgtgtgtatgtatctatatatatttattctaactcagcacttcagaagcctttttgagttacaacaatattttagtttgcctcatctgtagaggtaaaatttctatattaccaagctccagaggaatatgatattttacaggcacaattttctggctgtagtccctggggcattcatttgctggcctccatgggatgctgttagaacaattgttagccggcaagagaagaaaggctaccaggacagcatttataattgtagaatgggagccttcttccctctcccctccactttcattttagcatgagataaaaaaatagattggaaatgattgttgcatctcacttcatggaagtaggggcagaagttccctctggatccttttcttgacaagcagtcaagaggaaggtccccatacacatgtacctgtgtgatacttggtagtttctaagaatggtgctacataagcgttgctgttaggctgggatcctattaatgaacgtttgattagttcaggcctcccaatggcaaaggcagacaccgtggagatggacatttactgactccccttctgtgtggcttcggtctccctggctaacaccacacctgtgcgtactgcgctcggcccactttgctgcagaaacgtagcaagcgtttcatgtcagggctacagctgagagcaaaaactgcaaaaaaaaaaaaaaatgtctcattgaatgccagttgtctgatacaaatgcagtgtcttttaagtgacagaaacacacctaaatacctgcaactcaagctcgctagcattttttttttgagtacttgagataaaatccaaaacccaccctctaattttgtgctgtatttatatatatgtacataaatgtatatatagagaaatgttgagttcttctggattctgaatgtaaataattcttgtaaattgggactctgcccacctgtttctcccttttccctcttcccttcagctctatttattcttttcttgactttcccatatggggcatcttatgacttttttttttttttttttttaagaaaagtatggaaaacttttcatttagaaaagtatttgttcctgtattttagaattcagttttgcatctttgctgtagaattcctgttttgtgttaatgttttttactatgtcttattgtgttgtgtgcaatgcattgtactggggggatgcacttgagtgccatttctgatactgtcattgtatgactgctgatgctcgtttatgttgttctttggaagctatagtgagcctgatgttttcacattttaaaaaatgcttcctgagacttctttaagctcctctaacttcttcagtgcatttgggatcaaacttagctcttagatcagcaaacctgacttgcttctacttttgcaatttttcaggccttaccatatttcttatctctgtcttcccacctgataggaaaatcttgcagatttgaaacagtggtttctggcctgctgctgcagcaaattccctatgtttatttaagaagtcgggcctatgcttttaacctacaaatgatgagtaatttacttgcaatgaacacaggtagcctgctgctgtttataacctgttgaggatatttatagcaggcaggaggcaggcctagtgtgttattgacaggtgactttagagaatgtacattggccgggtgcggtggctcacgcctgtaatcccagcactttgggaggccgaggcgggcggatcatgaggtcaggagattgagaccatctcctggctaacacggtgaaaccccgtctctactaaaaatacaaaaaaaaaaaaaacttagccaggcgtggtggcgggtgcctgtagtcccagctactcaggaggctgaggcaggagaatggcatgaacctgggaggcagagcttgcagtgagcccagatcgcgccactgcactccagcctgggcaacagaccgagactccgtctcgaaaaaaaaaaaagagagagaatgtacattaaggaacaattgtcctccaaaagagagccaagcaactgctctggagcctcctaggctgactctgctggagggtgagacaagcagattcccattgcagcactggtccctggggtaccctgaacggctgtgctctccacccttgtatcggtgagtggatcttgtctacatcagccgtaagcctagaagcagagcgggatcgaggcgtttttaataattcgagttgggaagacccggatggttcatcaaaatgatggtgttgagcacccgggaggcagacattgggtatttgttcacaattttgcacctgtaagaaaatgttcctttataactttcaaggattgccgtgagcgtctttggggccttttcattcatgtacaagtttcattcattactattcaacttggtagacttggtgaaaaatgtaaaagcattctgtatttggatcagtcttgggaactaaatttgtcgtgaattggggcctgtcacagattgcctccagtgtgcatcctccacgcagaccctccttgctcagtctccctctggcgcccatggggaagccgtgctgtggttggcagtgcggccatctgggctgccgcaacgtggcagggcaccgtccagcaagactgccccttagtgcagggctaagcaaggaaaagaagaagcccaaaaaggcgggttctttttgatacttgtaattcaggcgtcctccagagtgaaggccactctgcaggcccctggtgagaacctgtctggcttttccactgcgggcccctaaccagtaccctgcccttgtggcccatttgtgcctgggcagatgtttctggccagcagacactgaaggcctttttgctgtgacagtatttatggcactgaagaggataaagaagcttgagccctctttctgactcccactttatggggcagagagagctttttttctacatagcacattgcagtctcaccgctatcagaaaaatatcctgttcatggtttatactgaatttgcaaactactgatatgatttttcaataaccacttgtatcttccatcatccatgagaggtgggaagaggtacactgtatctctgcaataaaactttggccaggttctacctcctctgagcaaaggatacttttctatgtaggtgtagatggttctcctttactaatctgacatggtgcatctggagacaacatctgatgggatccaaagacaacttgaaacaaaggtggatgtcagctcttggtgtgttttcatttggttctcttttttaaatctcccttttgttatcgctcctgttgtagcgtgtccatcagtgtgtgaagggtgcgccctgttccaatgatactgcattgctgcatccagcctttcgtgggagcacggtaccaagcgtccggaattgattatcccaatcatttttgatatgtaactgaaaaatttggtctcatgcaataaaaatgtactggctgcattttagcaaggtttatttactcttgcaagtaaaaacgatcaaccgtgaagcgtaacaaattctgtatttagtttttttttctgttgtggtggtttttgttttgttttttgtttttgtaagattctaaataaattaaatacgagtca

SEQ ID NO: 30203 - DNA, 2196 bp, Homo sapiens
atggtggagccagggcaagatttactgcttgctgctttgagtgagagtggaattagtccgaatgacctctttgatattgatggtggagatgcagggcttgcaactccaatgcctaccccgtcagttcagcagtcagtgccacttagtgcattagaactaggtttggagaccgaagcagcagttcctgttaaacaagaaccagagactgtacctactccagcactattaaatgtgaggcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctactgatgtaagcaatggtacagtaaagaaagagtcttctaataaagaaggagctagaatgtggataaacgacatgaagatgaggagtttttccccaaccatgaaggttcctgttgtaaaagaagatgatgaaccagaggaagaagatgaagaagaaatgggtcatgcagaaacctatgcagaatacatgccaataaaattaaaaattggcctacgtcatccagatgctgtagtggaaaccagctctttatccagtgttactcctcctgatgtttggtacaaaacatccatttctgaggaaaccattgataatggctggttatcagcattgcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttggttcattcgttaaataagtttaaatacggaaaaatttcttccaaacataatgggagtgtgaaaaagggtgttatttttgctacttactcttcacttattggtgaaagccagtctggcggcaagtataaaactaggttaaaacaacttctgcattggtgcggtgatgacttcgatggagtgatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcatcgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattgaaaaacattttcctgctccagacaggaaaaaactttatagtttactaggaatcgatttgacagctccaagtaacaacagttcgccaagagatagtccttgtaaagaaaataaaataaagaagcggaaaggtgaagaaataactcgagaagccaaaaaagcacgaaaaatgagtctaatgaggatgatgaaaatggtaagttca

SEQ ID NO: 30204 - DNA, 2196 bp, Homo sapiens
ctagaagaactcgaccagtgagcaggcgaggaaggggcgggagccggggtcccggtagcttctagtaggttccagaaggcggcgcgtgcggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttata

SEQ ID NO: 30205 - DNA, 5218 bp, Homo sapiens
gtggccgacagatggcgcctgcgcgttccattcgcctccaagtcgccgaagagcgaacaccccaaacaatcccgaagcgccaccaaaaaaaaaaaaaaaaaaaaaaaaaaaaaaaaaaaaaaaaagaaaaaaaaccccgccggatccgaccgccactttcaaaaccccccaccgctctagaaccgcgggagcttccgtccctgagtagaattcgagggtgtaaagaagaggaaggggaaaaatatcttgtaccagcccaggggtgaagaagcccccggcctgagaaagaaggaggagtgggggaggcgaacagtctcgttgctgcctctgtgtacgctgaggggggaggtggccaccgagtactaaattcacttgggaataaaagaaaaacataagaaaattataagagaaaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataacacgcaggtaacatggatgttagctcaaagacaacaagaggaagcaaggcaacagcaggagagagcagcaatgagctatgttaaactgcgaactaatcttcagcatgccattcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaa

SEQ ID NO: 30206 - DNA, 3838 bp, Homo sapiens
aggcgaacagtctcgttgctgcctctgtgtacgctgaggggggaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaa

SEQ ID NO: 30207 - DNA, 4281 bp, Homo sapiens
ttcatgtgacgggcccctctgcttctcccccgccccatcatctccagcgcgtggtgggggaactgctggggaaggcgattggcatcgatctctccatcccttccgaggcccgacttcggtggccaccgagtactaaattcacttgggaataaaagaaaaacataagaaaattataagagaaaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaaacaaa

SEQ ID NO: 30208 - DNA, 4393 bp, Homo sapiens
attcatgtgacgggcccctctgcttctcccccgccccatcatctccagcgcgtggtgggggaactgctggggaaggcgattggcatcgatctctccatcccttccgaggcccgacttcggtggccaccgagtactaaattcacttgggaataaaagaaaaacataagaaaattataagagaaaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataacacgcaggtaacatggatgttagctcaaagacaacaagaggaagcaaggcaacagcaggagagagcagcaatgagctatgttaaactgcgaactaatcttcagcatgccattcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaaacaaa

SEQ ID NO: 30209 - DNA, 5991 bp, Homo sapiens
cttcctagagagggaacaacattcatgtgacgggcccctctgcttctcccccgccccatcatctccagcgcgtggtgggggaactgctggggaaggcgattggcatcgatctctccatcccttccgaggcccgacttcggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagtatgttgtatgttttctcttgtactcaaagggggagggtggctataaatggtttgcaaatttatatctattatcacatcttttaatgtgtttggggaataatttatagagaataccatcagtttatatttttaataaatcatatgtatttacaatgaaa

SEQ ID NO: 30210 - DNA, 6045 bp, Homo sapiens
gggtggcccaaaatggagaacgcggagcagcgcaagatggaggctccgcttctctgtgtagcagtagatttaggttccttttctccggcaggctcctaagcctaggagagcccgaactggagcgcgtggtgggggaactgctggggaaggcgattggcatcgatctctccatcccttccgaggcccgacttcggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactgaaagcagctctacaaaggaggacttgctgcgtttaaagaaacaaatgagagtattttgtcagatatgtcaacattacctgaccaacgtgaatactactgttaaggaacaggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcagatggtcagcaagaggatgaagccagtaaaattgaagctctgcacaagagaagaaatttacttgcagcattttgtaagctaattgtatatactgtggtggagatgaatacagctgcagatatcttcaaacagtatatgaagtattataatgactatggagatatcatcaaagaaacaatgagtaaaacaaggcagatagacaaaattcagtgtgctaagacccttattctcagtctgcaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaaagatggcatagaatttgcttttaaagagcctaatccgcaaggggagagccatccacctttaaatttggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagtatgttgtatgttttctcttgtactcaaagggggagggtggctataaatggtttgcaaatttatatctattatcacatcttttaatgtgtttggggaataatttatagagaataccatcagtttatatttttaataaatcatatgtatttacaatgaaa

SEQ ID NO: 30211 - DNA, 385 bp, Homo sapiens
tcccctcgacaccccactaaagacagaagaaccgcggctcgatcgggtccgcggcggaagcgcggccaaacgaatgagaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatga

SEQ ID NO: 30212 - DNA, 676 bp, Homo sapiens
attcctggctctagcagggcctgctcgggagctgctggtgtttgttactgtcctcgcagcacttttctgccaaccttctctctctgcgtattggttaggagcaaaagcaggaggcggtctcctaattctgtctgtagcctagcgcgttgcgtttaagggtatatctgaacttattttgttaaaaaaaaggctctgggaagtggatgcatttgtttaatgacatataattcaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttga

SEQ ID NO: 30213 - DNA, 678 bp, Homo sapiens
agtgctgcttttcattcccacccccacccgcactgtctttctcaaggcacgaactgagctgatccttgccccaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaag

SEQ ID NO: 30214 - DNA, 742 bp, Homo sapiens
ggcccaaaatggagaacgcggagcagcgcaagatggaggctccgcttctctgtgtagcagtagatttaggttccttttctccggcaggctcctaagcctaggagagcccgaactggaggtggccaccgagtactaaattcacttgggaataaaagaaaaacataagaaaattataagagaaaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgag

SEQ ID NO: 30215 - DNA, 798 bp, Homo sapiens
atccttgccccaggtggccaccgagtactaaattcacttgggaataaaagaaaaacataagaaaattataagagaaaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtc

SEQ ID NO: 30216 - DNA, 2089 bp, Homo sapiens
gtggccgacagatggcgcctgcgcgttccattcgcctccaagtcgccgaagagcgaacaccccaaacaatcccgaagcgccaccaaaaaaaaaaaaaaaaaaaaaaaaaaaaaaaaaaaaaaaaagaaaaaaaaccccgccggatccgaccgccactttcaaaaccccccaccgctctagaaccgcgggagcttccgtccctgagtagaattcgagggtgtaaagaagaggaaggggaaaaatatcttgtaccagcccaggggtgaagaagcccccggcctgagaaagaaggaggagtgggggaggcgaacagtctcgttgctgcctctgtgtacgctgaggggggaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagagcttcaggaaaatcaagatgaaatagaaaatatgatgaatgcaatatttaaaggagtgtttgtacatagataccgtgatgcgatagctgaaattcgagctatttgcattgaagagattggcatttggatgaagatgtatagtgatgcctttcttaatgacagttatttaaaatatgttggttggactatgcatgataagcaaggtgaagtaagactcaaatgtcttactgctctacaagggctttattataacaaagagcttaattccaaactggaactttttaccagtcggttcaaggatagaattgtgtctatgacccttgacaaagaatatgatgttgcagtacaagcaataaaattactcactcttgttttacagagtagtgaagaagttctcactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgctt

SEQ ID NO: 30217 - DNA, 296 bp, Homo sapiens
gaggtaagttataaaatggcggaggcgaagcttctagaagtttggaggggcacccggagggcgcttggcccaccgtgaggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggc

SEQ ID NO: 30218 - DNA, 4198 bp, Homo sapiens
gcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatcca

SEQ ID NO: 30219 - DNA, 3194 bp, Homo sapiens
cgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgagatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccacacgtt

SEQ ID NO: 30220 - DNA, 3884 bp, Homo sapiens
cgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggcagtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgagattactgagagtcttccgttactaggtaagtcaccgcatccttataactccaggtga

SEQ ID NO: 30221 - DNA, 605 bp, Homo sapiens
gggcgagccgttgggattgcgcttgcgcacagcgtgtcttgtacgttcccgcgcttttctggaatctttcgcccccggaagggcagcggcgggcgcctgtgtggaagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaagg

SEQ ID NO: 30222 - DNA, 534 bp, Homo sapiens
atctttcgcccccggaagggcagcggcgggcgcctgtgtggaaggtggggtggccagagacacccgagggacctgaggtggggaccttccctgaaccctgctcggccagaagtcactcttccaggctctgacagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcag

SEQ ID NO: 30223 - DNA, 4450 bp, Homo sapiens
gtggcgatccggctcaaaaggcggggcctgggtggaacctagcctatggcaattgagaagccagattaaaggggttactagcagtctggtccaaaacccgcccaatggagtaggagattgagggtagcgggggtgggacctgggtgggggcggggctaaagcgggccgcccgcgtgcccaagcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatcc

SEQ ID NO: 30224 - DNA, 699 bp, Homo sapiens
gcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctgg

SEQ ID NO: 30225 - DNA, 2079 bp, Homo sapiens
ggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggatgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagaacgtgcccacactcccgctgcagccaataggcaccttaaatagccacttcgtgcggctggccgcggagctcggagggggaaaggcgacgctgacctgtgccccgctcgcccgcagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatata

SEQ ID NO: 30226 - DNA, 1956 bp, Homo sapiens
gcaccgcccccgcccgcaagaaagatggcagtggcctgatccgggcccgttggcggcgtcactgacgcttcgctccggtcctcggatcccgagcgcggggaggcagaccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggatgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttca

SEQ ID NO: 30227 - DNA, 728 bp, Homo sapiens
gctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggatgaggaaagcagcacctctcggaactttctggatttgcgtgctggcgtctgtcggcctcgatacccacaggctgcgcccctctcagcacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaa

SEQ ID NO: 30228 - DNA, 861 bp, Homo sapiens
gcccgcaagaaagatggcagtggcctgatccgggcccgttggcggcgtcactgacgcttcgctccggtcctcggatcccgagcgcggggaggcagaccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggatgaggaaagacatggcccacctggacctagagctctgtga

SEQ ID NO: 30229 - DNA, 1497 bp, Homo sapiens
aaccgaagcggctcaggaaggcagctgtcactgagcccctggaacagagcgagagtatcgtaagtaaccaggctcagccggtttctcaggccgctctagtcaaataaaccataaagatcagactcgggcttcttcacttccttctctccgtggtttcgccattagcttccggttccggggaggggccgagttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatgagtcactgtgttgttatttattaggtgtgctatttcattagctgcttaatcctttgagtcctaagactctttggagacgctatgaagctccaatgtgggcccttttaagagcttttcttgcatacaaaccttttctccctctactttgacttctctccaggcatctcatctttaatagatctttgactaattatagctaaaaactctcagagaatacagcataataaatagcca

SEQ ID NO: 30230 - DNA, 865 bp, Homo sapiens
ctgtcagaaccggattgggccgcggcggggacggaagcggcccctgggcccgaggggctggagccgggccggggcgatgtggagcgcgggccgcggcggggctgcctggccggtgctgttggggctgctgctggcgctgttagtgccgggcggtggtgccgccaagaccggtgcggagctcgtgacctgcgggtcggtgctgaagctgctcaatacgcaccaccgcgtgcggctgcactcgcacgacatcaaatacggatccggcagcggccagcaatcggtgaccggcgtagaggcgtcggacgacgccaatagctactggcggatccgcggcggctcggagggcgggtgcccgcgcgggtccccggtgcgctgcgggcaggcggtgaggctcacgcatgtgcttacgggcaagaacctgcacacgcaccacttcccgtcgccgctgtccaacaaccaggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagtgccaacacgcacaatacgtggaaggccatggaaggcatcttcatcaagcctagtgtggagccctctgcaggtcacgatgaactctgagtgtgtggatggatgggtggatggagggtggcaggtggggcgtctgcagggccactcttggcagagactttgggtttgtaggggtcctcaagtgcctttgtgattaaagaatgttggtctatg

SEQ ID NO: 30231 - DNA, 4038 bp, Homo sapiens
gctggacctgggcaccgccagccgcctgggcacgggactgggcgggggcgctgacctcggcctaggaggcccaggatcccggagacgcccgcgccctcaggaccctgcgggtcgcacgccctccccagcttctgctgctcgccgctcttcggcagggcgaggtcaggtgcccccttctcgcctctcttctcttctcttctcttcctcctccacttctgtgcccgcggagactccggccgcccccttccgcaggggtgtagtaatctgcggagctgacagcagccccgcagccaccctgcccgaagtctccggaagcggcacgagctcaggccgccgcagccccggcggacccactgttggacctgaggagccagccctcctcccgcacccaaacttggagcacttgacctttggctgttggagggggcaggctcgcgggtggctggacagctgcggagccgcgagggcatcttgcctggagaccgtcggctgcactcccgggctcctggctttgcctctgggatcccgaggtgtccacatcagacgcatgttgactgagacctagagtcatggatgtatgcgtccgtcttgccctgtggctcctctggggactcctcctgcaccagggccagagcctcagccatagtcacagtgagaaggcgacaggaaccagctcgggggccaactctgaggagtccactgcagcagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggagtcatcggcagaagctgcagctgaaggctctggatacagtgctctttgggcctcctctcttgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggctgcacaaggcccaggaggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggctgagaagataaaaaagaagagaaacacactctttggcaccttccacgtggcccacagctcttccctggatgatgtagatcataaaattctaacagctaagcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtcccctagcctgcagagcagtgttcggcagcgcctgacggagccacagcatggcctgggatctcagagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcgggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgccagaactgtaggttataaggcagtcactttttctctctactcccacccacacctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaaccac

SEQ ID NO: 30232 - DNA, 5154 bp, Homo sapiens
gaggcgggggattggtatgcgagcgaatgtgcgaggggagggaggcgtcccggcggagcgtggtactacgaccagcgcgggccggagggggcggggggatgcgccgcggcggcggcggcgcgggagctggggttggtgtttggcggcgccagagcagcggatcccggtctcgccgcagcagcagcgcgggtgtcgtgcaccgcctgaagacgccgtacctttctaccccccaccttttttttttttttttttaaataaccggaaccaatgaacgcagccgggatcagagctccggaggccgccggtgccgatgggaccaggctggcgcccggcgggagcccgtgtctgaggcggcgggggcggccggaggagtcgccggcggcggtggtggcgcctcgcggagccggcgagctgcaggcggccggggcgccgctgcgctttcacccggcttctcctcggcgccttcatcccgcctcgactcctggcccagcgtggggctggctgctgcggcggcggcgctgggctgcgttgctggtgctcgggctgctggtagccggagcggcggacggatgcgagcttgtgccccggcacctccgcgggcggcgggcgactggctctgccgcaactgccgcctcctctcccgccgcggcggccggcgatagcccggcgctcatgacagatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaggagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtgggattgtgctgatttttgttgataacacaaaaaacactatgttttctggagagctgtgtaagctgtcttgttgcttagttgcaatataagaaatagtgatgttttggacgtaagttgtcaacaaatttctattttatattgttatatttttatgtagtttgaaatgtaaaaatgttctaatatcaagattaacaaatataaatttatggtgcatttagattgcgttgtattaatttataaagtatggtgttcattaaattggtgggttgtataagggtagcttttgttgttaaaaaaacagtagagagttaagttccatatagcaacaaagtatgttaacatctagggagtttctgcttataccactttaaaaatatgcaatcataagtgatttggttactgcaatgcagatggatgtttggatgaacaactgatacattttagttagaatgctttttcagcattatggctaaaatatatgtctaacccagtgctatttaggtgaaaatgctaattgataaaccagaagtttcttttgagatttgctttaaagaaatgctttagtaagaatatgaacaatttcctgatgtctcctataaattgtgattgtttattctattactattgttaaaaacttgaatggtatttatattggctgatatttatatacttaatagattgagttctgtaagggcaaaaacggattgaaatgaacatagcgttttgcactaatgataagataacctgagaggtagggttgaggaacacagggttgaaagctgttggagaggggaaaagttgtgcataaagaactgaaaagggttctggagtgttcattcagagtgaagggaaaactttatccttctatttcttataaccagacaggaggagttcttccctttgaaaattgcaaaaggaatgagaactttgcagttggatgaatagagaagggaaaagttgctggagcacggagtgaagatgggaggagctgttagcaaggcccactgctgctcctgggtgagaagggagctctggagcaggaccagctgggggccggcactgctgcttagagtggaggaggctggccaaagagactgtgggctgttttcagtcagggagcatgtgcattgtttgtgctcaatttcagacactcatttataaacaaattcaaccaagggatatttactgctttatgttgcttatgataattattttgcattaatacagtatacacatttgtaaattcaacaggaaattattgagttttggaaagctacagtaatttctgtattacatcatttatatgtgaaaagttggacatttctgtaagtttttaaaattatccatttgttactttaacattttaaaattatggtgttttcctgattttaaaagcaatattttccttactgt

SEQ ID NO: 30233 - DNA, 5178 bp, Homo sapiens
gaggcgggggattggtatgcgagcgaatgtgcgaggggagggaggcgtcccggcggagcgtggtactacgaccagcgcgggccggagggggcggggggatgcgccgcggcggcggcggcgcgggagctggggttggtgtttggcggcgccagagcagcggatcccggtctcgccgcagcagcagcgcgggtgtcgtgcaccgcctgaagacgccgtacctttctaccccccaccttttttttttttttttttaaataaccggaaccaatgaacgcagccgggatcagagctccggaggccgccggtgccgatgggaccaggctggcgcccggcgggagcccgtgtctgaggcggcgggggcggccggaggagtcgccggcggcggtggtggcgcctcgcggagccggcgagctgcaggcggccggggcgccgctgcgctttcacccggcttctcctcggcgccttcatcccgcctcgactcctggcccagcgtggggctggctgctgcggcggcggcgctgggctgcgttgctggtgctcgggctgctggtagccggagcggcggacggatgcgagcttgtgccccggcacctccgcgggcggcgggcgactggctctgccgcaactgccgcctcctctcccgccgcggcggccggcgatagcccggcgctcatgacagatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaggagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggttgctgcttcatatctgattcaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtgggattgtgctgatttttgttgataacacaaaaaacactatgttttctggagagctgtgtaagctgtcttgttgcttagttgcaatataagaaatagtgatgttttggacgtaagttgtcaacaaatttctattttatattgttatatttttatgtagtttgaaatgtaaaaatgttctaatatcaagattaacaaatataaatttatggtgcatttagattgcgttgtattaatttataaagtatggtgttcattaaattggtgggttgtataagggtagcttttgttgttaaaaaaacagtagagagttaagttccatatagcaacaaagtatgttaacatctagggagtttctgcttataccactttaaaaatatgcaatcataagtgatttggttactgcaatgcagatggatgtttggatgaacaactgatacattttagttagaatgctttttcagcattatggctaaaatatatgtctaacccagtgctatttaggtgaaaatgctaattgataaaccagaagtttcttttgagatttgctttaaagaaatgctttagtaagaatatgaacaatttcctgatgtctcctataaattgtgattgtttattctattactattgttaaaaacttgaatggtatttatattggctgatatttatatacttaatagattgagttctgtaagggcaaaaacggattgaaatgaacatagcgttttgcactaatgataagataacctgagaggtagggttgaggaacacagggttgaaagctgttggagaggggaaaagttgtgcataaagaactgaaaagggttctggagtgttcattcagagtgaagggaaaactttatccttctatttcttataaccagacaggaggagttcttccctttgaaaattgcaaaaggaatgagaactttgcagttggatgaatagagaagggaaaagttgctggagcacggagtgaagatgggaggagctgttagcaaggcccactgctgctcctgggtgagaagggagctctggagcaggaccagctgggggccggcactgctgcttagagtggaggaggctggccaaagagactgtgggctgttttcagtcagggagcatgtgcattgtttgtgctcaatttcagacactcatttataaacaaattcaaccaagggatatttactgctttatgttgcttatgataattattttgcattaatacagtatacacatttgtaaattcaacaggaaattattgagttttggaaagctacagtaatttctgtattacatcatttatatgtgaaaagttggacatttctgtaagtttttaaaattatccatttgttactttaacattttaaaattatggtgttttcctgattttaaaagcaatattttccttactgt

SEQ ID NO: 30234 - DNA, 3922 bp, Homo sapiens
ccgcggcggcggcggcgcgggagctggggttggtgtttggcggcgccagagcagcggatcccggtctcgccgcagcagcagcgcgggtgtcgtgcaccgcctgaagacgccgtacctttctaccccccaccttttttttttttttttttaaataaccggaaccaatgaacgcagccgggatcagagctccggaggccgccggtgccgatgggaccaggctggcgcccggcgggagcccgtgtctgaggcggcgggggcggccggaggagtcgccggcggcggtggtggcgcctcgcggagccggcgagctgcaggcggccggggcgccgctgcgctttcacccggcttctcctcggcgccttcatcccgcctcgactcctggcccagcgtggggctggctgctgcggcggcggcgctgggctgcgttgctggtgctcgggctgctggtagccggagcggcggacggatgcgagcttgtgccccggcacctccgcgggcggcgggcgactggctctgccgcaactgccgcctcctctcccgccgcggcggccggcgatagcccggcgctcatgacagatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaggagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgtattcaccttgggctcggtgcgtgcaaaagtgaatgagactaagtagtaaagctctcaaaaaaaaaaaggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtgggattgtgctgatttttgttgataacacaaaaaacactatgttttctggagagctgtgtaagctgtcttgttgcttagttgcaatataagaaatagtgatgttttggacgtaagttgtcaacaaatttctattttatattgttatatttttatgtagtttgaaatgtaaaaatgttctaatatcaagattaacaaatataaatttatggtgcattt

SEQ ID NO: 30235 - DNA, 5154 bp, Homo sapiens; identical to SEQ ID NO: 30232

SEQ ID NO: 30236 - DNA, 3613 bp, Homo sapiens
agagcagcggatcccggtctcgccgcagcagcagcgcgggtgtcgtgcaccgcctgaagacgccgtacctttctaccccccaccttttttttttttttttttaaataaccggaaccaatgaacgcagccgggatcagagctccggaggccgccggtgccgatgggaccaggctggcgcccggcgggagcccgtgtctgaggcggcgggggcggccggaggagtcgccggcggcggtggtggcgcctcgcggagccggcgagctgcaggcggccggggcgccgctgcgctttcacccggcttctcctcggcgccttcatcccgcctcgactcctggcccagcgtggggctggctgctgcggcggcggcgctgggctgcgttgctggtgctcgggctgctggtagccggagcggcggacggatgcgagcttgtgccccggcacctccgcgggcggcgggcgactggctctgccgcaactgccgcctcctctcccgccgcggcggccggcgatagcccggcgctcatgacagatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaggagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggttgctgcttcatatctgattcaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtg

SEQ ID NO: 30237 - DNA, 3925 bp, Homo sapiens
ccgcggcggcggcggcgcgggagctggggttggtgtttggcggcgccagagcagcggatcccggtctcgccgcagcagcagcgcgggtgtcgtgcaccgcctgaagacgccgtacctttctaccccccaccttttttttttttttttttaaataaccggaaccaatgaacgcagccgggatcagagctccggaggccgccggtgccgatgggaccaggctggcgcccggcgggagcccgtgtctgaggcggcgggggcggccggaggagtcgccggcggcggtggtggcgcctcgcggagccggcgagctgcaggcggccggggcgccgctgcgctttcacccggcttctcctcggcgccttcatcccgcctcgactcctggcccagcgtggggctggctgctgcggcggcggcgctgggctgcgttgctggtgctcgggctgctggtagccggagcggcggacggatgcgagcttgtgccccggcacctccgcgggcggcgggcgactggctctgccgcaactgccgcctcctctcccgccgcggcggccggcgatagcccggcgctcatgacagatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaggagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgtattcaccttgggctcggtgcgtgcaaaagtgaatgagactaagtagtaaagctctcaaaaaaaaaaaggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtgggattgtgctgatttttgttgataacacaaaaaacactatgttttctggagagctgtgtaagctgtcttgttgcttagttgcaatataagaaatagtgatgttttggacgtaagttgtcaacaaatttctattttatattgttatatttttatgtagtttgaaatgtaaaaatgttctaatatcaagattaacaaatataaatttatggtgcatttaga

SEQ ID NO: 30238 - DNA, 4114 bp, Homo sapiens
ttttgtttggctgaggggagcgagcggcgctttgggggaggggtcgcgtaggcgcctcacctgaccctgcggccgtgcggttgctgctccggggcaggtctccttccaggccaggggcccggaatcatgtacataaagcaggtgattatccagggttttcgaagttacagagatcaaacaattgtagatcccttcagttcaaaacataatgtgattgtgggcagaaatggatctggaaaaagtaactttttttatgcaattcagtttgttctcagtgatgagtttagtcatcttcgtccagaacagcggttggctttattgcatgaaggtactggtcctcgtgttatttctgcttttgtggagattatttttgataattcagacaaccggttaccaatcgataaagaggaagtttcacttcgaagagttattggtgccaaaaaggatcagtatttcttagacaagaagatggtcacgaaaaatgatgtgatgaacctccttgaaagcgctggtttttctcgaagcaatccttattatattgttaaacaaggaaagatcaaccagatggcaacagcaccagattctcagagattaaagctattaagagaagtagctggtactagagtgtatgacgaacgaaaggaagaaagcatctccttaatgaaagaaacagagggcaaacgggaaaaaatcaatgagttgttaaaatacattgaagagagattacatactctagaggaagaaaaggaagaactagctcagtatcagaagtgggataaaatgagacgagccctggaatataccatttacaatcaggaacttaacgagactcgtgccaaacttgatgagctttctgctaagcgagagactagtggagaaaaatccagacaattaagagatgctcagcaggatgcaagagataaaatggaggatatcgaacgccaagttagagaattgaaaacaaaaatttcagctatgaaagaagaaaaagaacagcttagtgctgaaagacaagagcagattaagcagaggactaagttggagcttaaagccaaggatttacaagatgaactagcaggcaatagtgaacaaaggaaacgtttattaaaagagaggcagaagctgcttgaaaaaatagaagaaaagcagaaagaactggcagaaacagaacccaaattcaacagtgtgaaagagaaagaagaacgaggaattgctagattggctcaagctacccaggaaagaacggatctttatgcaaagcagggtcgaggaagccagtttacatcaaaagaagaaagggataagtggattaaaaaggaactcaagtctttagatcaggctattaatgacaagaaaagacagattgctgctatacataaggatttggaagacactgaagcaaataaagagaaaaatctggagcagtataataaactggaccaggatcttaatgaagtcaaagctcgagtagaagaactggacagaaaatattacgaagtaaaaaataagaaagatgaactacaaagtgaaagaaactacttgtggagagaagagaatgcagaacagcaagcacttgctgctaaaagagaagatcttgaaaagaagcaacaacttcttagagcagcaacaggaaaggccattttaaatggaatagacagcataaacaaagtgctagaccacttccgtcgaaaaggaataaaccagcatgttcaaaatggctatcatggtattgtaatgaataactttgaatgtgaaccagctttctacacatgcgtggaagtcactgctggaaacaggttattttatcacattgttgattcagatgaagtcagcacgaagattttaatggagtttaataaaatgaatcttcctggagaggttacttttctgcctcttaacaagttagatgtcagggatacagcctatcctgaaaccaatgatgctattcctatgatcagcaaactgaggtacaatcccagatttgacaaagctttcaaacatgtgtttggaaagactcttatttgtcgtagcatggaagtttcaacccagctggcccgtgctttcactatggactgtattactttggaaggtgaccaagtcagccatcggggtgctctaactgggggttattatgacacaaggaagtctcgacttgaattgcaaaaagatgttagaaaagcagaagaagaactaggtgaacttgaagcaaagctcaatgaaaacctgcgcagaaatattgaaaggattaataatgaaattgatcagttgatgaaccaaatgcaacagatcgagacccagcaaaggaaatttaaagcatctagagatagcatattatcagaaatgaagatgctaaaagagaagaggcagcagtcagagaaaaccttcatgcctaagcaacgtagcttacagagtttggaggcaagcttgcatgctatggagtctaccagagagtcattgaaagcagaactgggaactgatttgctttctcaactgagtttggaagatcagaagagagtagatgcactgaatgatgagattcgtcaacttcagcaggaaaacagacagttgctaaatgaaagaattaaattagaaggtattattactcgagtagagacttatctcaatgagaatctgagaaaacgcttggaccaagtagaacaggaacttaatgagctgagagagacagaagggggtactgttctcacagccacaacatcagaacttgaagccatcaataaaagagtaaaagacactatggcacgatcagaagatttggacaattccattgataaaacagaagctggaattaaggagcttcagaagagtatggagcgctggaaaaatatggaaaaagaacatatggatgctataaatcatgatactaaagaactggaaaagatgacaaatcggcaaggcatgctattgaagaagaaagaagagtgtatgaagaaaattcgagaacttggatcacttccccaggaagcatttgaaaagtaccagacactgagcctcaaacagttgtttcgaaaacttgagcagtgcaacacagaattaaagaagtacagccatgttaacaaaaaggctttggatcagtttgtaaatttctccgagcagaaagaaaagttaataaagcgtcaagaagagttagataggggttacaaatcaatcatggaactgatgaatgtacttgaacttcggaaatatgaagctattcagttaactttcaaacaggtatctaagaacttcagtgaagtattccagaagttagtacctggtggcaaagctactttggtgatgaagaaaggagatgtggagggcagtcagtctcaagatgaaggagaagggagtggtgagagtgagaggggttctggctcacaaagcagtgtcccatcagttgaccagtttactggagttggaattagggtgtcatttacaggaaaacaaggtgaaatgagagaaatgcaacagctttcaggtggacagaaatccttggtagcccttgctctgatttttgccattcagaaatgtgacccggctccattttacttgtttgatgaaattgaccaggctctggatgctcagcacagaaaggctgtgtcagatatgattatggaacttgctgtacatgctcagtttattacaactacttttaggcctgaactgcttgagtcagctgacaaattctatggtgtaaagttcagaaataaggttagtcatattgatgtgatcacagcagagatggccaaagactttgtagaagatgataccacacatggttaattggaaaatactacctactggtttgggagatgtatatagtaatatgattctcatacccaggaactgtaaatttaaacctaaatatttggccaatagttttcagacttaaagcatcatagtccttttatatttgtctttgtattttataagatactctgtaatgtcatgtttgtactgatagtttaagaatttaatttcctgtacaactttttgtaaaatgttctgctcctattttaaatgttttgaaacatgctaaatattctttcctaattattttatcacttatactaccttttttatagcttcaattaaataatcggttttatgactaata

SEQ ID NO: 30239 - DNA, 5921 bp, Homo sapiens
cgcctgggctgccggacggtgggaacggaagtcgctgtgggacgctgaggaagccaggatggcgactccgagcaagaagacgtcaactccaagcccccagccttccaagagagctctcccgagagacccttcgtcggaggtcccgagcaagaggaagaattcggccccgcagctgccgctgttgcagtcgtccgggcctttcgtggaaggctctatcgtccgcatctcgatggagaacttcctaacatatgatatttgtgaagtatctcctggaccccacttgaatatgatcgttggagccaatggaacagggaagtcgagcattgtgtgtgccatttgccttggtttagctggaaaacctgctttcatgggacgagcagataaggttgggttttttgtgaagagaggatgttctagaggcatggttgaaattgaattgttcagggcttctggaaatcttgtaatcacccgtgagattgatgtggcaaaaaatcagtccttttggttcatcaacaaaaaatctacaacccagaaaatagtggaagagaaagttgcagccttaaatattcaagtggggaatctttgccagtttctccctcaggacaaagttggagaatttgctaaactcagcaaaattgaactcctcgaagccactgaaaagtcaattggtcccccagaaatgcacaaatatcactgtgaactcaaaaacttaagggagaaagaaaaacagctcgagacctcatgcaaagagaaaactgagtatctacagaaaatggttcagaggaatgaaagatataaacaagatgtggagaggttctatgaacggaagcgacatttagatttaattgagatgcttgaagcaaaaaggccatgggtggaatatgaaaatgttcgtcaggaatatgaagaagtaaaactagttcgtgaccgagtgaaggaagaggtcagaaaacttaaagaagggcagattcctgtaacatgtcgaattgaagaaatggaaaacgagcgtcacaatttggaggctcgaatcaaagaaaaggcaacagatattaaggaggcatctcaaaaatgcaaacagaagcaagatgttatagaaaggaaagataaacatattgaggaacttcagcaggctttaatagtaaagcaaaatgaagagcttgaccgacagaggagaataggtaatacccgcaaaatgatagaggatttgcaaaatgaactaaagaccacggaaaactgcgagaatcttcagccccagattgatgccattacaaatgatctgagacggattcaggatgaaaaggcattatgtgaaggcgaaataattgataagcgaagagagagggaaactctagagaaggagaaaaagagtgtggacgatcatattgtacgttttgacaatcttatgaatcagaaggaagataagctaagacagagattccgtgacacgtatgatgctgttttatggctaagaaataacagagacaaatttaaacaaagagtctgtgagcccataatgctcacgatcaatatgaaagataataaaaatgccaaatatattgaaaatcatattccatcaaatgacttaagagcctttgtatttgaaagtcaagaagatatggaggttttcctcaaagaggttcgtgacaataaaaaattaagagtaaatgctgttattgctcccaagagttcatatgcagacaaagcaccttcaagatctttgaatgaacttaaacaatacggatttttctcttatttgagagaattatttgatgcacctgatcctgtaatgagttacctttgctgtcagtatcatattcatgaagttcctgtaggaactgaaaagaccagagaaagaattgaacgggtaatacaagaaacccgattaaaacagatttatacagcagaagaaaagtatgtggtgaaaacttctttttattcaaacaaagttatttctagtaacacatctctaaaagtagcgcagtttctcactgtcactgtggacctagagcagagaagacacttagaagaacagctaaaggaaattcatagaaaattgcaagcagtggattcagggttgattgccttacgtgaaacaagcaaacatctggagcacaaagacaatgaacttagacaaaagaagaaggagcttcttgagagaaaaaccaagaaaagacaactggaacaaaaaatcagttccaaactaggaagtttaaagctgatggaacaggatacttgcaatcttgaagaggaagagcgaaaagcaagtaccaaaatcaaagaaataaatgttcaaaaagcgaaacttgttaccgaattaacaaacctaataaagatttgtacttctttgcatatacaaaaagtagatttaattctccaaaatactacagtgatctctgagaagaacaaattagaatcagattatatggccgcatcttcacaactccgtcttacagagcaacatttcattgaattggatgaaaatagacagagattattgcagaaatgcaaggaacttatgaaaagagctaggcaagtatgtaacctgggtgcagagcagactcttcctcaagaataccagacacaagtacccaccattccaaatggacacaactcctcactccccatggttttccaagaccttccaaacacattggatgaaattgatgctttattaactgaagaaagatcaagagcttcctgcttcacgggactgaatcctacaattgttcaggaatatacaaaaagagaagaagaaatagaacagttaactgaggaactaaagggaaagaaagttgaactagatcaatacagggaaaacatttcacaggtaaaagaaaggtggcttaatcctttaaaagagctggtagaaaaaattaatgaaaaattcagcaatttttttagttccatgcagtgtgctggtgaagttgatctccatacagaaaatgaggaagattatgataaatatggaattcgaattagagtcaaatttcgaagtagtactcaactgcatgaattaactcctcatcatcaaagtggaggtgaaagaagtgtttctaccatgttatacttgatggcacttcaggagctaaatagatgtccattcagagtagttgatgaaatcaatcagggaatggacccaatcaatgaacggagagtgtttgaaatggttgtaaatactgcctgtaaagaaaatacatctcaatactttttcataacaccaaagctcctgcaaaatcttccttattctgaaaagatgacagttttgtttgtctacaatggccctcatatgctggaaccaaacacatggaatttaaaggctttccaaaggcggcggcgccgtattacattcactcaaccttcttaataaaagtaaagagagggaacttgggaattttttttgttaaattctgtttataagtatggctcaactgaataaaaggagattcactaaaacgaaaagcagttatttttggaaacctgcttttaaatacaaataggttgataatggaaactataatgacctttccaaaatagcagctggtagtaaaagttaagtcttcttcagtcttggttgaacttgagttcttggcactctgaccatgagtcattcagttctcatgttaaaatgtacttaatattacaaatcaaaggtacagtggaagaagggttaatcacaagaagttacttatatggtagccctgagctttaattgcagagtaactttaattacttttagagcctaaagatgactctagagcctaagtcctagtttctcccaatgttatatttaattttaaaaaattgatatgaaaatgtctaatgtatagtaataatttatgacagatctagtcatttcttcctattaaaaaagattaccttatctccagtaggaaatggaattttatgggcctttaaaagaaagttttatgaaacttgatgctataattttattggtatttcaaggggaaaaaagcactggggttcaaaaatggtagcagaactgctttgaaatgctgcaaggtggccactagatgatgcaaaatacaaccaaaagattgactgagaataaaattaggtgacaagggtttttaaagaataaccttttaaagtgtgggggcaggggttgcttttttttattttatttaaagtcaattatattttacatcttacatttctaaaagcattttataattatttttagtaagatttttcttaaaatttcatatactggtttctacaatttatatttgaaatttctcagtgttatgtaaagagtgatggaaaagcattgatttctttaaaaccgtaatgtttttagaacttaagcctatagggcctttcttacaatgttgatgtacccattatcttagaaaatctagtttaaactgttttctttcaccgcaaaagaattaaatgggaaaatcatttgtttatctctaagttatactaattagtagaaccaaacaaattatcttcttttaaaaaataaatcttataggaaaatagacagtccaaagtcatgtctttgaacagtggattggatctgtgccagtaatgacaaaattatttttttgacttgcttgcctgaataaattgaagaattgctttcagtttgggttttgtatattcttaagtagccattgaaatttatattcttaactaggtcaaaaaataatgagccataagtttatgtcctctcacttagacattttctctttaaaaaggtattttcttctttataaacattttaaaagagccttcccttcttaaactaactccagtgcatgaagtgtgaaaatattttaaaatgacatttttactaatatgagcaagtcatgtaaacattgaagaacttggtaacatattagtaaatggatattaccaaatgttttcatcgttaattactttgcgttccaccaaaatatctttactaaaatgtgcttggtgtagtttgtttattgtctaaattagtaccagtcatcttatttctgcaaaatgagtatcaatgtgaaaaagacacgtgaagattaagcatgtttgaaaataaaatggtcaattacatttcaatttacataggccaacaactgttccatactttgtttgtaaacatttaatttctctactggacaaaattaatatttggctttacattgaattttgagctgtgaagaataaattatgtatcattttagcatattaaacagtagtaagtctagcacatagtctcagccacttaaaacaaaagtttttttgtttgtttgtttgtttgtttttttgagatggagtctcactctgttgcccaggctggagtgcagtggcgtgatctcggcttactgcaacctccgcctcccgggttcaagcgattctcctgcctcagcctcccaagtaactgggacaacaggcgcgtcccaccacacccagctaattttttatacttttagtagagatggggtttcagcatattggccaggctggtctcgaactcctgaccttgtgatccacccgcctcggcctcccaaagtgctgggattataggcgtgagcccctgcacccggccaaaagttgatttttaattacataaaaatcgtaaaaacttctagtaaaaacttgatttggtgaatacagttatatttaaaaaccttaaggtgacaagcattttctatgcctaaatcttcattggtttgcctggaaagagtctctgttaaaagattttccatattcaaagtaaaaggaaagatttcttgctttctaattgtcttttggacacatgcctattttctttgaggtataaacctttagatgtgaaaaatgtaatttcattctgctattgtgtgtgcttgtgtgtgtgtaattgaaaaaactgggaaatcctgctttgttggtaataaatcaatatttttatattcttttggtgtatgtta

SEQ ID NO: 30240 - DNA, 5173 bp, Homo sapiens
ggagggcggggcgcaggcgcggttagtaccgcggtgggcgccggggctcccgggaatctaccttctcctgcggccggcacgcggttcccagggggccagcggcggtcagccgaggtcgagacgcccgcagggtggccttagcggccggtcgtaccacggcagccccgccgatcaggttcctttgggagacttcgacttgttggcgacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctgcccttgaaaaagatattaaacacaatgaggaacttcttaaaaggtgccaactacattataaagaactaaagatgaaaataagaaaaaatatttctgaaattcgggaacttgagaacatagaagaacaccagtctgtagatattgcaactttggaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagctagcagacccacttaaggatgaattaaaccttgctgattctgaagtggataaccaaaaacgagggaaacgacattatgaagaaaaacaaaaagaacacttggataccttaaataaaaagaaacgagaactggatatgaaagagaaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctgaaatgaaagaaactcctttatatatccaaccacaatcaaacatataaataagcctggaaaaccaactacaacctgcaatttaagattactattactttaagaaaatcaatttcatagtattggttttaaatctttttaagtttttttaatacgatctatttttataggttctttttcagaagtaaaattttgtacatatatacatgtacatatctgtttagtttgggttcatttctataacattttgtaagaaaataaaagtttgagcacctgattatatttagttttgcttttccagatattacattctatagttaccaaaaatggttgaagggagggatttctcattgcagagggtggggtgcaagggaataagacacttgtacggaacactgaagctttgccaacttctacacatgccttttttgcagtcctttaactgtccaccctaccaagagcttataaccagtatcagaactggataatgacgcagtttttcactctgacctccatcatgcttgcctgatttaaaagccctcagtttgcagtccagggactgttcaggcttgtcctcagctgagaggacacaggctagagggactgtgcagaaccaggctgggagaagggctgggaaaactgggagtggagggtggatcctcatggagcaggagagtagctcatggctccaggagcctgaggccatgcagttgatggtgagctgacatcaattctaagactcatcctaattgaggggtgttaaaaagtgtgctgcttagaatgaccaaatatagttattgtaaaaaatgatatttatgaactttttattttagaaaacatgaattttattgctccctgtattatttgtttgatactaggattcatgctaaactttttaagaatgtattggatatcaagaagcattccttacattagtagcaataaatattagaataaatatgaaattgaactattttcagaaaaagggcagtatattaagagcagggactgttctctagttattgaggaaaactggactttgtttgtgtttttggtggaggaagaagtttaagatactttagtcttaaattgaggtttgccaaatgagaagttcaaaaacttgggctttctaatcagaatttccaggaggaggaaagtgtgtgctgaatattttaaacatttcccactgatcatacaaagtctgatttttaaatttacacttataatgcctttgtattaaaattatttttaacatgtgcttttccaaattaaaaatgaagtagagtataccaaatgcataaactttcattagctaaggaactcatgtctgaattttgttgtagttttgaatgttgtgctctttcatacagaatgggaaacataatcctcaggtatcccagcatctcttgttgaattgaagattattcattgctttggcctcacaaagttttgatttcaactatcataagtgaaaatatcttcctttaatgttctaagtagtgataatattactagaatgaaagaataaaaagaaattgttcttttaaaatatgtgtaacttctaaaaataaaacttaaaatttatatgta

SEQ ID NO: 30241 - DNA, 3724 bp, Homo sapiens
accgcggtgggcgccggggctcccgggaatctaccttctcctgcggccggcacgcggttcccagggggccagcggcggtcagccgaggtcgagacgcccgcagggtggccttagcggccggtcgtaccacggcagccccgccgatcaggttcctttgggagacttcgacttgttggcgaaatgaaccggagaagaatcccaattgggaattgcggaaaacaggactctagggtagagaaaggttgtagaaccaatagggtttgagacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagttggagtgcagtggtgcgatctcggctcaatgcaacctctgcctcccaggttcaagcgattctcctgtttcagccttgtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctgcccttgaaaaagatattaaacacaatgaggaacttcttaaaaggtgccaactacattataaagaactaaagatgaaaataagaaaaaatatttctgaaattcgggaacttgagaacatagaagaacaccagtctgtagatattgcaactttggaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagctagcagacccacttaaggatgaattaaaccttgctgattctgaagtggataaccaaaaacgagggaaacgacattatgaagaaaaacaaaaagaacacttggataccttaaataaaaagaaacgagaactggatatgaaagagaaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctg

SEQ ID NO: 30242 - DNA, 3729 bp, Homo sapiens
tagctcaaaatgttctaaagataaaatctaatgatttcttataggaaggctaggcttggtgggtacaagtaagaaagccaagcagagagaagcttcctggtccttctccacctttccctttcctccagtctggactttgccttctccacctccttggaagacaggctgctcatcccattgtggtgtctcggctggtgtatgttttctgcctaggcttaatggacagcacgaggaggtagggactgacgttacccatgttttacagtggaagaacctgaggcttaaagagatggagtttcgctcttcttgcccaggctagagtgcaatggcacggtctcagctcactgcaacctccgcctcccgggttcaagtgattctcttgtctcagcctcccaaacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctgcccttgaaaaagatattaaacacaatgaggaacttcttaaaaggtgccaactacattataaagaactaaagatgaaaataagaaaaaatatttctgaaattcgggaacttgagaacatagaagaacaccagtctgtagatattgcaactttggaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagctagcagacccacttaaggatgaattaaaccttgctgattctgaagtggataaccaaaaacgagggaaacgacattatgaagaaaaacaaaaagaacacttggataccttaaataaaaagaaacgagaactggatatgaaagagaaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaa

SEQ ID NO: 30243 - DNA, 544 bp, Homo sapiens
gataatgactgtgcctgtatgtatggacacgatgttctttcttctcatagctcaaaatgttctaaagataaaatctaatgatttcttataggaaggctaggcttggtgggtacaagtaagaaagccaagcagagagaagcttcctggtccttctccacctttccctttcctccagtctggactttgccttctccacctccttggaagacaggctgctcatcccattgtggtgtctcggctggtgtatgttttctgcctaggatggagtttcgctcttcttgcccaggctagagtgcaatggcacggtctcagctcactgcaacctccgcctcccgggttcaagtgattctcttgtctcagcctcccaaacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatg

SEQ ID NO: 30244 - DNA, 5233 bp, Homo sapiens
accgcggtgggcgccggggctcccgggaatctaccttctcctgcggccggcacgcggttcccagggggccagcggcggtcagccgaggtcgagacgcccgcagggtggccttagcggccggtcgtaccacggcagccccgccgatcaggttcctttgggagacttcgacttgttggcgaaatgaaccggagaagaatcccaattgggaattgcggaaaacaggactctagggtagagaaaggttgtagaaccaatagggtttgagacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctgcccttgaaaaagatattaaacacaatgaggaacttcttaaaaggtgccaactacattataaagaactaaagatgaaaataagaaaaaatatttctgaaattcgggaacttgagaacatagaagaacaccagtctgtagatattgcaactttggaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagctagcagacccacttaaggatgaattaaaccttgctgattctgaagtggataaccaaaaacgagggaaacgacattatgaagaaaaacaaaaagaacacttggataccttaaataaaaagaaacgagaactggatatgaaagagaaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctgaaatgaaagaaactcctttatatatccaaccacaatcaaacatataaataagcctggaaaaccaactacaacctgcaatttaagattactattactttaagaaaatcaatttcatagtattggttttaaatctttttaagtttttttaatacgatctatttttataggttctttttcagaagtaaaattttgtacatatatacatgtacatatctgtttagtttgggttcatttctataacattttgtaagaaaataaaagtttgagcacctgattatatttagttttgcttttccagatattacattctatagttaccaaaaatggttgaagggagggatttctcattgcagagggtggggtgcaagggaataagacacttgtacggaacactgaagctttgccaacttctacacatgccttttttgcagtcctttaactgtccaccctaccaagagcttataaccagtatcagaactggataatgacgcagtttttcactctgacctccatcatgcttgcctgatttaaaagccctcagtttgcagtccagggactgttcaggcttgtcctcagctgagaggacacaggctagagggactgtgcagaaccaggctgggagaagggctgggaaaactgggagtggagggtggatcctcatggagcaggagagtagctcatggctccaggagcctgaggccatgcagttgatggtgagctgacatcaattctaagactcatcctaattgaggggtgttaaaaagtgtgctgcttagaatgaccaaatatagttattgtaaaaaatgatatttatgaactttttattttagaaaacatgaattttattgctccctgtattatttgtttgatactaggattcatgctaaactttttaagaatgtattggatatcaagaagcattccttacattagtagcaataaatattagaataaatatgaaattgaactattttcagaaaaagggcagtatattaagagcagggactgttctctagttattgaggaaaactggactttgtttgtgtttttggtggaggaagaagtttaagatactttagtcttaaattgaggtttgccaaatgagaagttcaaaaacttgggctttctaatcagaatttccaggaggaggaaagtgtgtgctgaatattttaaacatttcccactgatcatacaaagtctgatttttaaatttacacttataatgcctttgtattaaaattatttttaacatgtgcttttccaaattaaaaatgaagtagagtataccaaatgcataaactttcattagctaaggaactcatgtctgaattttgttgtagttttgaatgttgtgctctttcatacagaatgggaaacataatcctcaggtatcccagcatctcttgttgaattgaagattattcattgctttggcctcacaaagttttgatttcaactatcataagtgaaaatatcttcctttaatgttctaagtagtgataatattactagaatgaaagaataaaaagaaattgttcttttaaaatatgtgtaacttctaaaaataaaacttaaaatttatatgta

SEQ ID NO: 30245 - DNA, 2819 bp, Homo sapiens
gtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaacca

SEQ ID NO: 30246 - DNA, 785 bp, Homo sapiens
gccaacagaaatccattacaatatataagagctaagatttcttgtcccttttcacctttatttgccgtctttcaactggcaagagtcattttgaccagcagattaatcaactgtaagacagatcctcacacaaagaggcaactgaaaggatgaaatcactgacttggatcttgggcctttgggctcttgcagcgtgtttcacacctggtgagagtcaaagaggccccaggggaccatatccacctggaccgctggctcctcctcaaccttttggcccaggatttgttccaccacctcctcctccaccctatggtccagggagaatcccacctcctcctcccgcaccctatggtccagggatatttccaccaccccctcctcaaccctaaggtccaccactccatcctgatgccccaggttatccacagcctccttcccgaccaagaccctatccacctggacctccatttttccctgtaaattctccaactgatcctaccctccctactcctgcaccccaaatatgaacaactgcagcaggtgccaccaccaccacaaaagacaccactacccttgtaactactgcttctactacccaaaatatgaattccaacactgcttccaagagacatttacataaaattgcttccatttttggatgagaatgaaaaattccaaaagtgctgagctttggggagaaataatcttagaaagaaattgtagaaaaaacccatgcagacataacatttataccaatgaggcaaaaataaagaattgagcaccaa

SEQ ID NO: 30247 - DNA, 473 bp, Homo sapiens
gccaacagaaatccattacaatatataagagctaagatttcttgtcccttttcacctttatttgccgtctttcaactggcaagagtcattttgaccagcagattaatcaactgtaagacagatcctcacacaaagaggcaactgaaaggatgaaatcactgacttggatcttgggcctttgggctcttgcagcgtgtttcacacctggtgagagtcaaagaggccccaggggaccatatccacctggaccgctggctcctcctcaaccttttggcccaggatttgttccaccacctcctcctccaccctatggtccagggagaatcccacctcctccctactcctgcaccccaaatatgaacaactgcagcaggtgccaccaccaccacaaaagacaccactacccttgtaactactgcttctactacccaaaatatgaattccaacactgcttccaagagacatttacataa

SEQ ID NO: 30248 - DNA, 489 bp, Homo sapiens
aacagaaacaagttgctgtgaattactcaacaaggtcctgtgtacttagctgacatgtggtgatggggtgaaaagaatgagtatgtgtgattcttcttaatattgttatttcaccctgattcaagagtcattttgaccagcagattaatcaactgtaagacagatcctcacacaaagaggcaactgaaaggatgaaatcactgacttggatcttgggcctttgggctcttgcagcgtgtttcacacctggtgagagtcaaagaggccccaggggaccatatccacctggaccgctggctcctcctcaaccttttggcccaggatttgttccaccacctcctcctccaccctatggtccagggagaatcccacctcctcctcccgcaccctatggtccagggatatttccaccaccccctcctcaaccctaaggtccaccactccatcctgatgccccaggttatccacagcctccttcccgaccaagac

SEQ ID NO: 30249 - DNA, 1131 bp, Homo sapiens
gtggctttgccctttggcctttgctggctgtgtggcggctccgcggttcgcaggtcgttcgctgagcgtctctgcttagccgcggtcatgagccggcacagccggctgcagaggcaggttctgagcctgtaccgcgatctgctgcgcgccgggcgtgggaagccgggcgccgaggcgcgagtgcgggcagagttccggcagcatgcgggcctgccgcggtccgacgtgctgcgcatcgagtacctgtaccgccgcgggcggcgccagctgcagctgctacgctcgggccacgccaccgccatgggcgccttcgtacgcccgcgggccccgaccggggagcctggcggcgtgggttgccagcctgacgacggcgacagtccaaggaacccccacgacagcacgggggcaccggagacccgccccgacggacggtgacaggcgaagagccgaactcgctcgatggcgtggtggagccaggaggctcgcctgactgcatggggggactggggaacccgcctaaggtgagaggtcttaagagactagcttgacgaattggggatgtcagagactcctccttggcgacgcagggggcctagagagccccgtgatggacggcaagggaggcccgccttttccgatgcttggagacaggtcggtgctcctcccccatgagggcttggggcggcctgggacgctggcgggctggacagtgtcaagccaagagctacttgcccgaaggtacggggagccaggacgacccccggtggacagggagagcctgagacgcccttctcttgacccctgagaacatacccacttctggctcctcaaggagtctcccctctcctgtatttaactctgagaagtgcagactttttgctgagaacgttttgggaaggtgccctgatgagcggtgagaagcccggaatccccttctggaaaactttcccccattaattgtgacaagccaggaccatgaggaaggggtaggggtctatcaccctggttgatcaactgaagacccccaaaggcccctacttgatggttttgaggggcaacattgactcatttgccccttccctctcggaatgttggacaaagggaataaaattggggatatgtctacttccc

SEQ ID NO: 30250 - DNA, 2033 bp, Homo sapiens
cgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtatggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgagggccacaggcaggagtggtgtgggcacactgcttaggagtcaacatcttcatcattgggctttctttaaaacgtgcactttgtaatttgaaagagaattattaaagcatactgaaaaaaggaaatttacaatttcccagccctcacaattaattttaattttgtctattttcatataacccatagtcatgtttatagagttttacaagttcacaattacaggttttattttcatgtagcactatagaaaactttccccctcattcctacagtcttcacaattagttgactaaataataatacataagaaataatatattagaatgaattagttagaagtgtttttaaaagctctagggctgtgtgacttctgtgttgctagtggtgccctccctggaggggttttgccctcagagctgtaatctaggcagtagaatcagtcacccagactggaccaggtgcatctaaaggtgttgactagaagaaggtcggccagatttgatgagcaggtggttggtgattataggagccgcacacagggactacacacgcacatgtttccagcattgttgagctccagggttcctacagagccacctcatggttcctgcctgctcttcagtatccctggtggctcaggagggaagggaagagatctagcctttacgtaatcacagttaagcctcacagcactctagactagtggtgttacctgtattttatacataagaaagtgggctcagagagaggaagtaatttgtccaaggtcaggtagctattgagtcgaaaaagcagaatttagtatagctcagtctgcctccaaagctcttgaactttctactagaacacactgccttactgctggaaatttaatagaagtctctgtttgggaaagctgtggcaaatagatgtgacagttct

SEQ ID NO: 30251 - DNA, 1153 bp, Homo sapiens
acccgggaaaccggaagccgcctcccacttggttgctcgtacgcggctagtgggtcctcagtggatgtaggctgggcgccgcgatgttcgacgggacaccggcggagagcgacctcggggttaaggggtggggctgacgtcaggagccaagatggcggcggtggtcgccctctccttgaggcgccggttgccggccacaacccttggcggagcctgcctgcaggcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaatgttattctactttattaacaaaaaaaaaa

SEQ ID NO: 30252 - DNA, 1127 bp, Homo sapiens
acttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcagatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatc

SEQ ID NO: 30253 - DNA, 1420 bp, Homo sapiens
agctaggcagagctgagcggagaagctccagagccttttaaagagactctcgtcacatgacacccccaaccccgacccccagccggcgcgcctccgccctcgggtggcggggccgcctggcgtcacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttga

SEQ ID NO: 30254 - DNA, 369 bp, Homo sapiens
tccagaccggaacccaagatggctgcgctgttgctgagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtga

SEQ ID NO: 30255 - DNA, 460 bp, Homo sapiens
cttccgtccagaccggaacccaagatggctgcgctgttgctgagacacgttggtcgtcattgcctccgagcccactttagccctcagctctgtatcagaaattggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcc

SEQ ID NO: 30256 - DNA, 1439 bp, Homo sapiens
gacgggtgtgcaccgcctctcgacttccggttcacccagcatttcctcttccctgttttctttcgtcgtcgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaagtgtcttctatgctttta

SEQ ID NO: 30257 - DNA, 1689 bp, Homo sapiens
gccgaggggacggggtccgactcagaaatggcggcctccatgttctacggcaggctagtggccgtggccacccttcggaaccaccggcctcggacggcccagcgggctgctgctcagggtcctgtattaataggaagttcacatggtggtgtcaacattgaagatgttgctgctgagtctcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttcttttgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatg

SEQ ID NO: 30258 - DNA, 1952 bp, Homo sapiens
gccgaggggacggggtccgactcagaaatggcggcctccatgttctacggcaggctagtggccgtggccacccttcggaaccaccggcctcggacggcccagcgggctgctgctcaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagtctcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttcttttgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatg

SEQ ID NO: 30259 - DNA, 2098 bp, Homo sapiens
ccgcctgtcgcctgtgcgcctgcgcgcggcgccgaggggacggggtccgactcagaaatggcggcctccatgttctacggcaggctagtggccgtggccacccttcggaaccaccggcctcggacggcccagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagtctcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttcttttgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatga

SEQ ID NO: 30260 - DNA, 2164 bp, Homo sapiens
ccgcctgtcgcctgtgcgcctgcgcgcggcgccgaggggacggggtccgactcagaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagtctcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttcttttgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatga

SEQ ID NO: 30261 - DNA, 1471 bp, Homo sapiens
agtccgcgaggatccccggcggcccggccgtggctgctcctgcagtttctaagagatgggcgggagcaggtgggctctgagtggaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagtctcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttc

SEQ ID NO: 30262 - DNA, 1381 bp, Homo sapiens
gaggggacggggtccgactcagaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaataacaatggaaaggtcatttcaaggtcctgtattaataggaagttcacatggtggtgtcaacattgaagatgttgctgctgagtctcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggat

SEQ ID NO: 30263 - DNA, 1801 bp, Homo sapiens
ctcacgcacggcacacggaagcaagcacggcgtgagttcgtccctctgcgcacgccccggtttcctcgcgtccgcggctgctcacccgaactccagatgacctccagggagttggaaactgccagctccaaccgagcctttcctcttccccaggaggacgcaacgcggatgcttgcagctggtcaccacgactccgactccgactcctggccgccgcccgcgcggctgtgcgctggccgtcatagcgcgcgggaggacgcgcctggcagcggcaggaagtgacgcgctcactaccccgtcccgcggccgcagccaatctctccccgcgagggcggaggcgccgaaatcaaagcgagagcgcctcggcctctccagctgtccgcgggtcttgctctgttgcctaggctggagtgcagtggtacaagcacggctcactgcagccttgacctcctgggatcaagggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagtctcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgt

SEQ ID NO: 30264 - DNA, 1890 bp, Homo sapiens
gacggggtccgactcagaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggtacagaagaaagaaataatatgtgcaggataaactgtaactatgagtatttctggcaagttctctgggaccagaactcacaagtaataagaagcaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagtctcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttcttttgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataacta

SEQ ID NO: 30265 - DNA, 1475 bp, Homo sapiens
atgttaatcaaacccacatttctaggaaggagccgagttattatctgcctctccgataggatgcctctttgtcttcacctgccattcccgctgtttcgtgaagaatcctctgtaaagggaaatttgttcaggcgactgctgtggccaccctctgcctcctccggcctctgcccctgggaggtccccgggggcctgggagtgtcattggcgtatgaccgcaacccttgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaaccactccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtaaaattggcatcatgcctggccatattcacaaaaaaggaaggattggcattgtgtccagatctggcaccctgacttatgaagcagttcaccaaacaacgcaagttggattggggcagtctttgtgcgttggcattggaggtgatccttttaatggaacagattttattgactgcctcgaaatctttttgaacgattctgccacagaaggcatcatattgattggtgaaattggtggtaatgcagaagagaatgctgcagaatttttgaagcaacataattcaggtccaaattccaagcctgtagtgtccttcattgctggtttaactgctcctcctgggagaagaatgggtcatgccggggcaattattgctggaggaaaaggtggagctaaagagaagatctctgcccttcagagtgcaggagttgtggtcagtatgtctcctgcacagctgggaaccacgatctacaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagatgttttcaccacattgtattacagagacagccaataaatctactatttgatttcaatatgg

SEQ ID NO: 30266 - DNA, 6011 bp, Homo sapiens
ttattttggcagccttatccaagtctggtacaacatagcaaagagaacaggctatgaaataagatggcaagaaagaaatttagtggattggaaatctctctgattgtcctttttgtcatagttactataatagctattgccttaattgttgttttagcaactaagacacctgctgttgatgaaattagtgattctacttcaactccagctactactcgtgtgactacaaatccttctgattcaggaaaatgtccaaatgtgttaaatgatcctgtcaatgtgagaataaactgcattccagaacaattcccaacagagggaatttgtgcacagagaggctgctgctggaggccgtggaatgactctcttattccttggtgcttcttcgttgataatcatggttataacgttcaagacatgacaacaacaagtattggagttgaagccaaattaaacaggataccttcacctacactatttggaaatgacatcaacagtgttctcttcacaactcaaaatcagacacccaatcgtttccggttcaagattactgatccaaataatagaagatatgaagttcctcatcagtatgtaaaagagtttactggacccacagtttctgatacgttgtatgatgtgaaggttgcccaaaacccatttagcatccaagttattaggaaaagcaacggtaaaactttgtttgacaccagcattggtcccttagtgtactctgaccagtacttacagatctcaacccgtcttccaagtgattatatttatggtattggagaacaagttcataagagatttcgtcatgatttatcctggaaaacatggccaatttttactcgagaccaacttcctggtgataataataataatttatacggccatcaaacattctttatgtgtattgaagatacatctggaaagtcattcggtgtttttttaatgaatagcaatgcaatggagatttttatccagcctactccaatagtaacatatagagttaccggtggcattctggatttttacatccttctaggagatacaccagaacaagtagttcaacagtatcaacagcttgttggactaccagcaatgccagcatattggaatcttggattccaactaagtcgctggaattataagtcactagatgtagtgaaagaagtggtaaggagaaaccgggaagctggcataccatttgatacacaggtcactgatattgactacatggaagacaagaaagactttacttatgatcaagttgcgtttaacggactccctcaatttgtgcaagatttgcatgaccatggacagaaatatgtcatcatcttggaccctgcaatttccataggtcgacgtgccaatggaacaacatatgcaacctatgagaggggaaacacacaacatgtgtggataaatgagtcagatggaagtacaccaattattggagaggtatggccaggattaacagtataccctgatttcactaacccaaactgcattgattggtgggcaaatgaatgcagtattttccatcaagaagtgcaatatgatggactttggattgacatgaatgaagtttccagctttattcaaggttcaacaaaaggatgtaatgtaaacaaattgaattatccaccgtttactcctgatattcttgacaaactcatgtattccaaaacaatttgcatggatgctgtgcagaactggggtaaacagtatgatgttcatagcctctatggatacagcatggctatagccacagagcaagctgtacaaaaagtttttcctaataagagaagcttcattcttacccgctcaacatttgctggatctggaagacatgctgcgcattggttaggagacaatactgcttcatgggaacaaatggaatggtctataactggaatgctggagttcagtttgtttggaatacctttggttggagcagacatctgtggatttgtggctgaaaccacagaagaactttgcagaagatggatgcaacttggggcattttatccattttccagaaaccataattctgacggatatgaacatcaggatcctgcattttttgggcagaattcacttttggttaaatcatcaaggcagtatttaactattcgctacaccttattacccttcctctacactctgttttataaagcccatgtgtttggagaaacagtagcaagaccagttcttcatgagttttatgaggatacgaacagctggattgaggacactgagtttttgtggggccctgcattacttattactcctgttctaaaacagggagcagatactgtgagtgcctacatccctgatgctatttggtatgattatgaatctggtgcaaaaaggccatggaggaaacaacgggttgatatgtatcttccagcagacaaaataggattacatcttagaggaggttatatcatccccattcaagaaccagatgtaacaacaacagcaagccgtaagaatcctctaggacttatagtcgcattaggtgaaaacaacacagccaaaggagactttttctgggatgatggagaaactaaagatacaatacaaaatggcaactacatattatatacattttcagtttctaataacacattagatattgtgtgcacacattcatcatatcaggaaggaactaccttagcatttcagactgtaaaaatccttgggttgacagacagtgttacagaagttagagtggcggaaaataatcaaccaatgaacgctcattccaatttcacttatgatgcttctaaccaggttctcctaattgcagatctcaaacttaatcttggaagaaactttagtgttcaatggaatcaaattttctcagaaaatgaaagatttaattgttatccagatgcagatttggcaactgaacaaaagtgcacacaacgtggctgtgtatggagaacgggttcttctctatccaaagcacctgagtgttactttcccagacaagataactcttattcagtcaactcagctcgctattcatccatgggtataacagctgacctccaactaaatactgcaaatgccagaataaagttaccttctgaccccatctcaactcttcgtgtggaggtgaaatatcacaaaaatgatatgttgcagtttaagatttatgatccccaaaagaagagatatgaagtaccagtaccgttaaacattccaaccaccccaataagtacttatgaagacagactttatgatgtggaaatcaaggaaaatccttttggcatccagattcgacggagaagcagtggaagagtcatttgggattcttggctgcctggatttgcttttaatgaccagttcattcaaatatcgactcgcctgccatcagaatatatatatggttttggggaagtggaacatacagcatttaagcgagatctgaactggaatacttggggaatgttcacaagagaccaaccccctggttacaaacttaattcctatggatttcatccctattacatggctctggaagaggagggcaatgctcatggtgttttcttactcaacagcaatgcaatggatgttacattccagccaactcctgctctaacttaccgtacagttggagggatcttggatttttatatgtttttgggcccaactccagaagttgcaacaaagcaataccatgaagtaattggccatccagtcatgccagcttattgggctttgggattccaattatgtcgttatggatatgcaaatacttcagaggttcgggaattatatgacgctatggtggctgctaacatcccctatgatgttcagtacacagacattgactacatggaaaggcagctagactttacaattggtgaagcattccaggaccttcctcagtttgttgacaaaataagaggagaaggaatgagatacattattatcctggatccagcaatttcaggaaatgaaacaaagacttaccctgcatttgaaagaggacagcagaatgatgtctttgtcaaatggccaaacaccaatgacatttgttgggcaaaggtttggccagatttgcccaacataacaatagataaaactctaacggaagatgaagctgttaatgcttccagagctcatgtagctttcccagatttcttcaggacttccacagcagagtggtgggccagagaaattgtggacttttacaatgaaaagatgaagtttgatggtttgtggattgatatgaatgagccatcaagttttgtaaatggaacaactactaatcaatgcagaaatgacgaactaaattatccaccttatttcccagaactcacaaaaagaactgatggattacatttcagaacaatttgcatggaagctgagcagattcttagtgatggaacatcagttttgcattacgatgttcacaatctctatggatggtcacagatgaaacctactcatgatgcattgcagaagacaactggaaaaagagggattgtaatttctcgttccacgtatcctactagtggacgatggggaggacactggcttggagacaactatgcacgatgggacaacatggacaaatcaatcattggtatgatggaatttagtctgtttggaatgtcatatactggagcagacatctgtggttttttcaacaactcagaatatcatctctgtacccgctggatgcaacttggagcattttatccatactcaaggaatcacaacattgcaaatactagaagacaagatcccgcttcctggaatgaaacttttgctgaaatgtcaaggaatattctaaatattagatacaccttattgccctatttttacacacaaatgcatgaaattcatgctaatggtggcactgttatccgaccccttttgcatgagttctttgatgaaaaaccaacctgggatatattcaagcagttcttatggggtccagcatttatggttaccccagtactggaaccttatgttcaaactgtaaatgcctacgtccccaatgctcggtggtttgactaccatacaggcaaagatattggcgtcagaggacaatttcaaacatttaatgcttcttatgacacaataaacctacatgtccgtggtggtcacatcctaccatgtcaagagccagctcaaaacacattttacagtcgacaaaaacacatgaagctcattgttgctgcagatgataatcagatggcacagggttctctgttttgggatgatggagagagtatagacacctatgaaagagacctatatttatctgtacaatttaatttaaaccagaccaccttaacaagcactatattgaagagaggttacataaataaaagtgaaacgaggcttggatcccttcatgtatgggggaaaggaactactcctgtcaatgcagttactctaacgtataacggaaataaaaattcgcttccttttaatgaagacactaccaacatgatattacgtattgatctgaccacacacaatgttactctagaagaaccaatagaaatcaactggtcatgaagatcaccatcaattttagttgtcaatgggaaaaaacaccaggatttaagtttcacagcacttacaattttccctcttcacttggttcttgtactctacaaaatatagctttcataacatcgaaaagttattttgtagcgtacatcaatgataatgctaattttattatagtaatgtgacttggattcaattttaaggcatatttaacaaaatttgaatagccctatttatccttgttaagtatcagctacaattgtaaactagttactaaacatgtatgtaaatagctaagatataatttaaacgtgatttttaaattaaataaaatttttatgtaattatatatactatatttttctcaatgtttagcagatttaagatatgtaacaacaattatttgaagatttaattacttcttagtatgtgcatttaattagaaaaagagaataaaaaatgtaagtgta

SEQ ID NO: 30267 - DNA, 5710 bp, Homo sapiens
aggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 30268 - DNA, 4891 bp, Homo sapiens
tttgtctggcagcgttggttctatgggggtgtgtgatgataataatacgcgggcttatataaccgtcttcatcttgcgagcacttcgcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaa

SEQ ID NO: 30269 - DNA, 4697 bp, Homo sapiens
gtgatgataataatacgcgggcttatataaccgtcttcatcttgcgagcacttcgcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttgtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaa

SEQ ID NO: 30270 - DNA, 5551 bp, Homo sapiens
aggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaactttttt

SEQ ID NO: 30271 - DNA, 806 bp, Homo sapiens
aggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggtt

SEQ ID NO: 30272 - DNA, 630 bp, Homo sapiens
ggagtttggatttcattttagtctcaccgtctccgtttttctctgactgcccagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacact

SEQ ID NO: 30273 - DNA, 460 bp, Homo sapiens
atataatatgctgttgcaagagactacttcagatcgaaaatctgtttttaaaatcattgactgatatttcctttgtatttttttctcccccttccaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccacctt

SEQ ID NO: 30274 - DNA, 585 bp, Homo sapiens
tctcttttagcatagttttgaatggaatgctagcacggcacacttgtcaaagccagttgttgctgtcctatcaatgctgctattgtacggctgacagatgacggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacc

SEQ ID NO: 30275 - DNA, 593 bp, Homo sapiens
cctgtgctatctgtgccttaccagtctcaccaacaataagcctggtgactgacaatcgagagggggctctgtccacgtaggtgccggcacaagctgaggacatgagtgggacagaggaaccagccttgcacggaggaagcaccttttccttctggtgattgattgatgggggacagtgaggaggttttcagagactggaaaaaattgtcccagtcacttactatgaagtctttgtcagcagaaaagactctccggggtagagaatgatataatgcagatgacaaatgacaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagc

SEQ ID NO: 30276 - DNA, 4915 bp, Homo sapiens
cacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttaacccaacagggattt

SEQ ID NO: 30277 - DNA, 4183 bp, Homo sapiens
gggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgaatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttggg

SEQ ID NO: 30278 - DNA, 1825 bp, Homo sapiens
ttcagtggcactggaggccttcccgactattcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttggg

SEQ ID NO: 30279 - DNA, 3905 bp, Homo sapiens
ctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgaatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctggatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaa

SEQ ID NO: 30280 - DNA, 4238 bp, Homo sapiens
gggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgaatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttggga

SEQ ID NO: 30281 - DNA, 2159 bp, Homo sapiens
acgtgaccaaccgggtcacatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggctgagaagtttggcgactcctttgtctttgaaggcatgttgagtgagcaagtgaagaccaatattcaacaggcagttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgagtttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccaaaaggtcccccttctgggaaagaccgagtgaagaaaggtggatcctacatgtgccataggtcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcagtcgtgtctgacctacattgggcttttctcagaactttgaacgatcccatgcaaagaattcccaccctgaggtgggttacatacctgcccaatggccaaaggaaccgccttgtgagaccaaattgctgacctgggtcagtgcatgtgctttatggtgtggtgcatctttggagatcatcaccatattttacttttgagagtctttaaagaggaaggggagtggagggaaccctgagctaggcttcaggaggcccgcgtcctacgcaggctctgccacaggggttagaccccaggtccgacgcttgaccttcctgggcctcaagtgccctcccctatcaaatgaagggatggacagcatgacctctgggtgtctctccaactcaccagttctaaaaagggtatcagattctattgtgacttcatagtgagaatttattatagattattttttagctattttttccatgtgtgaaccttgagtgatactaatcatgtaaagtaagagttctcttatgtattattttcggaagaggggtgtggtgactcctttatattcgtactgcactttgtttttccaaggaaatcagtgtcttttacgttgttatgatgaatcccacatggggccggtgatggtatgctgaagttcagccgttgaacacataggaatgtctgtggggtgactctactgtgctttatcttttaacattaagtgcctttggttcagaggggcagtcataagctctgtttccccctctccccaaagccttcagcgaacgtgaaatgtgcgctaaacggggaaacctgtttaattctagatatagggaaaaaggaacgaggaccttgaatgagctatattcagggtatccggtattttgtaatagggaataggaaaccttgttggctgtggaatatccgatgctttgaatcatgcactgtgttgaataaacgtatctgctaaatcagg

SEQ ID NO: 30282 - DNA, 1281 bp, Homo sapiens
atggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggctgagaagtttggcgactcctttgtctttgaaggcatgttgagtgagcaagtgaagaccaatattcaacaggcagttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgagtttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccaaaaggtcccccttctgggaaagaccgagtgaagaaaggtggatcctacatgtgccataggtcccaagagtactatgatccctattttcaagatgtggcatctgagatgttgagaagacacacagccagcaggtggaaggccttctcatctctagaaccatgctgctcaatacgtaggcatcagcaatatgcagctattgaacgtttgacatgtggcaagtttgaattgagatgtgctagtttaagaaaaatagattgcctcaacaccaacattgcctgtagctactccatgaggcaagatggacccagactccactgtgtggactga

SEQ ID NO: 30283 - DNA, 3157 bp, Homo sapiens
atggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggctgagaagtttggcgactcctttgtctttgaaggcatgttgagtgagcaagtgaagaccaatattcaacaggcagttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgagtttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccaaaaggtcccccttctgggaaagaccgagtgaagaaaggtggattatcaaaggctcaccagaggatttcacaggagtactatgatccctattttcaagatgtggcatctgagatgttgagaagacacacagccagcaggtggaaggccttctcatctctagaaccatgctgctcaatacgtaggcatcagcaatatgcagctattgaacgtttgacatgtggcaagtttgaattgagatgtgctagtttaagaaaaatagattgcctcaacaccaacattgcctgtagctactccatgaggcaagatggacccagactccactgtgtggactgacctcccagaaggatcctcctgtccctgaaggccactctgccttcagctacaggccccagtgctgattgtgatacttaacaagggctttcagatgtctgaaacaagagtatagcataaagttaagaatgcggcttctggagagacagacttggtttcaaattcagctctgtgaccttgggtgcacagcaaagtcttcttctccccccgatgaaagaatgggaaggactcaggaaggctcaacttgcaaactccccagtatcaagtggctgccttcaaaatccaacccttctcttcccagctcatttccagtatgtattttcaaaggccatgtcatttttgaagtgcctgagaagaaaacagaactgccagcagactatgggacaaacgactaaatgccctccagacgttccagagtcctctgcctctcaggcttcagttcttcctgaaggaatctggagctggaaagcaggaagcaatttgctgtggaattttttccatcacagactccaagttcctcagcctttggactcttgaacttacaccagtgttttggcaggagcgctcgggcctttggccacagactgaaggctgcattgtcagcttccctacttttgaggttttgggactcagactgatccaccactggcttccttgctcttcaacttgaagacggcctatcgtgagactttacctcgtgattatgtgagtcaattctcctaataaactccccttcgtatgtacatataccctattacttctgtccctttagagaaccctgactaatacagtagagattgcctggacttattaataataatgactctgtttagttaatgtaacagacagataaagacaaatgagtgacacccatgcaattaaaataattttggtggggagtgagaggagttggttctccactcacagtggaaagttttagcgtatactgctgcacatgacatgggagtattttgcacttccactggaaaaaagtaaggggaataaaaacccctggattctacttgctgacttgagagtgactaaagcgatttatctgaaggttccccagggtggattcatagtggactcaggccagattctctgctgatgctttgaacttatgtccagagcatcatctccaccacaaaagagcttgcctgctctgtgtcctggccaaagagatgcacgtgctctctcactgggttgtggctcttgagtaactcctggaattacccagctggaatttctattcctttggaccacaaatttcatatcttcacctgctgcctatatcatgctaaaagatggaaatgtctcaactaaaccatgtaggtggactagcctcattaacaagataagcaatgggccattttctcactggttattaactatgtacattatctatgaaataacatatctggtcatggttactactctattctgtagggtggaatagaaaaaggtagaggatatatatttcagttgcatttttaaaattgtttattttgttttttaattgacaaataatattaggttggtgcaaaagtaattgcagtttttgccattaaaggtagacaaggctgggcacggtggctcagcacgcttgtaatcccagcactttgggaggcagaggcgggcagatcacaaggtcaggagaccgagaccatcctggctaacacggtgaaaccccatctctactaaaaatacaaaaaattagccgggtgtggtggtgggcacctgtagtcccagctactcgggaggctgaggcaggagaatggcgtgaacctgggaggtggagcttgtagtgagctgcaccactgcactccagcctgggcaacagagcaagaccccatatc

SEQ ID NO: 30284 - DNA, 1447 bp, Homo sapiens
acatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgagtttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccaaaaggtcccccttctgggaaagaccgagtgaagaaaggtggatcctacatgtgccataggtcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcagtcgtgtctgacctacattgggcttttctcagaactttgaacgatcccatgcaaagaattcccaccctgaggtgggttacatacctgcccaatggccaaaggaaccgccttgtgagaccaaattgctgacctgggtcagtgcatgtgctttatggtgtggtgcatctttggagatcatcaccatattttacttttgagagtctttaaagaggaaggggagtggagggaaccctgagctaggcttcaggaggcccgcgtcctacgcaggctctgccacaggggttagaccccaggtccgacgcttgaccttcctgggcctcaagtgccctcccctatcaaatgaa

SEQ ID NO: 30285 - DNA, 1128 bp, Homo sapiens
aaccgggtcacatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggctgagaagtttggcgactcctttgtctttgaaggcatgttgagtgagcaagtgaagaccaatattcaacaggcagttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgagtttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccatcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcag

SEQ ID NO: 30286 - DNA, 2364 bp, Homo sapiens
agtgagaggtcacttactgcagccggacataacggcgctggccccgccccttctcgagaactcgcagagctgggctggtaaaattgcagtgctgaagacactggacccgcaaaaggctgtccctcccaaacctgggattctgggctcactgagttcacctgcgagtcagccctacctgcactgctctggtctagtacaaacaggctgctggcattgaggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataa

SEQ ID NO: 30287 - DNA, 2306 bp, Homo sapiens
aatggttgagccacccgcttccagccaatggctgagggataagctgaggggagtgagaggtcacttactgcagccggacataacggcgctggccccgccccttctcgagaactcgcagagctgggctggtaaaattgcagtgctgaagacactggacccggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataa

SEQ ID NO: 30288 - DNA, 2860 bp, Homo sapiens
gtaatatagggtttggtgcaatctgtggtttcaaacatctactgggggtcgtagaacatatccccagtggataagggggtactactgtacttgttggctcttcatgttagctctgctaggcagatgtcatttcagagatgaggaagcaagttcagaacggcttggaatcttgctcaggaaatcgggctggttaatgaataacaagagatccagtttcacaaacccaaggcattttgcccccagaatctgggcttcttcacccatttaggctgtcactacttttttttcacttttttatccctgtttaagtcagtctgacccacagttgtcctctgctgacttcagaaataataatctggccagtagacatttggtttcggtcctttaggcccttcgccccaggcatcgttctctatggtggacaaagttcagaatggaagatgggagaaaggtgattctgattctagaagcacccatccctcctaccccattccccacccgcattacctgccatcctgtcagcacagtctgtctctgaagtgctccaagttttctctaagggcccatttggactcccactctcaagactcctcacttgcccagaaagctccttgctgaccttctctgtgtcttcctctcacccattcccttaggcctccctaatatcccctcccagggtctccctatcttgatcccagaatcttccttctacaggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataa

SEQ ID NO: 30289 - DNA, 2394 bp, Homo sapiens
gaactcgcagagctgggctggtaaaattgcagtgctgaagacactggacccgcaaaaggctgtccctcccaaacctgggattctgggctcactgagttcacctgcgagtcagccctacctgcactgctctggtctagtacaaacaggctgctggcattgagggacggagtctccaactcctggcctctagcagtcctcctgtgtaggtctcccaaagtgctagtgtgtccggaattggtgggttcttggtctcactgacttcaagaatgaagccgcggaccctcgcagtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttata

SEQ ID NO: 30290 - DNA, 952 bp, Homo sapiens
actggacccggtaaggagactgggggtggtaaagaagctggggaggaagggctgctgagctgggcagcggagggggccttggtgtccagctgtgctccgaacctcaagggcaacaaaactatcagtacctgcctccactccttctgtctgggtgctcttgagatcgcggggtgttgccgcaagacccttttgtgcctggatgccggacgtatgttcctacctaacgtgcccatggggagtgaggggtcatcacctgcaccaacgggtggcatttctgtattacagcaaaaggctgtccctcccaaacctgggattctgggctcactgagttcacctgcgagtcagccctacctgcactgctctggtctagtacaaacaggctgctggcattgaggcccttcgccccaggcatcgttctctatggtggacaaagttcagaatggaagatgggagaaaggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcc

SEQ ID NO: 30291 - DNA, 556 bp, Homo sapiens
aactcgcagagctgggctggtaaaattgcagtgctgaagacactggacccgcaaaaggctgtccctcccaaacctgggattctgggctcactgagttcacctgcgagtcagccctacctgcactgctctggtctagtacaaacaggctgctggcattgagggacggagtctccaactcctggcctctagcagtcctcctgtgtaggtctcccaaagtgctagtgtgtccggaattggtgggttcttggtctcactgacttcaagaatgaagccgcggaccctcgcagtgagtgttacagttcttaaaggcagcgtgtccggagtttgttccttctgatgttcagatgtgtttggagtttcttccttctggtgggttcgtgctcttgctggctcaggagtgaagctgcagaccttcacagtctgctacaatgctgctgctgcacagagctgtggtcctcaggctccaacaggcctgcagactcaagtcaatcccctcaaggatctgcattcaggcctgctccacaaatgattcatttcagccccagcgccccagcct

SEQ ID NO: 30292 - DNA, 2352 bp, Homo sapiens
agctgggctggtaaaattgcagtgctgaagacactggacccgagacaggttttccccattttggccaggctggtctcaaactcctgacctcaggtgatttgcccgcctcagcctcccaaagtgctgggattacagacgtgagccactgcgccgggcattgttgttaatctcttactgtgggtaatttagtaattaaactataagaggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataa

SEQ ID NO: 30293 - DNA, 2511 bp, Homo sapiens
ctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgagagcaaggggcacaaccgtctccctttatagttctacttttctaataaatagtctgtttaagatcataactcttgggcctggggagtgagcctattgcaggaggaaggatgcatttgtactgggatgtataatgagattagaccaaaacaaacaaaactggggaggaagacagagaggaagtaggcttgtaggttaagaagtagggcttccggctgagcacagtggctcacgcctgtaatcccagcacttgggaggccaaggcaggtggatcacttgaggtcaggagttcgagaccagcctggccaacatggcaaaacccagtctctaccaaaaatacaaaaattagctgggtgtggtggtgggtgcctgtaatcccagctacttgggaggctgaggcaggagaatcgcttgaaccaaggaggcagagttcaagcaattctgtctcagcctcccaggtagctgggacgacaggcgcacaccgccacgcccggctaatttcttttgtattttagtagagatgggtttcaccatgttgcccaggctggtctcgaactcctgagctcaggcagtacgtctgcctcggcctcccaaagtgctaggattacaggcgtgagccaccaagcccggcttttttttttttttttt

SEQ ID NO: 30294 - DNA, 543 bp, Homo sapiens
agagctgggctggtaaaattgcagtgctgaagacactggacccgggacggagtctccaactcctggcctctagcagtcctcctgtgtaggtctcccaaagtgctagtgtgtccggaattggtgggttcttggtctcactgacttcaagaatgaagccgcggaccctcgcagtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccagggggg

SEQ ID NO: 30295 - DNA, 919 bp, Homo sapiens
atgacgtcacgcctgcggagctgccgccgcgcgccggtggggcgcgagcgtgtgcggggcgcgggcgcgggcgcgggcgcgggcgcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggcaccagcttgctgcaggaggtggtctacttggtgagccagggcgctgaccccgatgagatcggcttgatgaacatcgacgagcagctcccggtcctggagtacccacagccgggcctggacatcatcaaggaactgacctctccccgcctcatcaagagccacctgccctaccgctttctgccctctgacctccacaatggagactccaaggtcatctatatggctcgcaaccccaaggatctggtggtgtcttattatcagttccaccgctctctgcggaccatgagctaccgaggcacctttcaagaattctgccggaggtttatgaatgataagctgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccgggcacattgcgtctttgctcggaagatcttcttgagttggtga

SEQ ID NO: 30296 - DNA, 2468 bp, Homo sapiens
cggagctgccgccgcgcgccggtggggcgcgagcgtgtgcggggcgcgggcgcgggcgcgggcgcgggcgcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggcaccagcttgctgcaggaggtggtctacttggtgagccagggcgctgaccccgatgagatcggcttgatgaacatcgacgagcagctcccggtcctggagtacccacagccgggcctggacatcatcaaggaactgacctctccccgcctcatcaagagccacctgccctaccgctttctgccctctgacctccacaatggagactccaaggtcatctatatggctcgcaaccccaaggatctggtggtgtcttattatcagttccaccgctctctgcggaccatgagctaccgaggcacctttcaagaattctgccggaggtttatgaatgataagctgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccggggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagaatggacgtccttctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcaggtggcacgtggcatcgcatggtgggctcggcagcaccttgcctgtgtttctgtgagggaggctgctttctgtgaaatttcatttatatttttctatttttagtactgtatggatgttactgagcactacacatgatccttctgtgcttgcttgcatctttaataaagacatgttcccggc

SEQ ID NO: 30297 - DNA, 1100 bp, Homo sapiens
gcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccgtgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccggggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgtt

SEQ ID NO: 30298 - DNA, 1876 bp, Homo sapiens
cgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcgtggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaa

SEQ ID NO: 30299 - DNA, 1155 bp, Homo sapiens
ccactttcttgctgttgtgatggtggtaagggaacgggcctggctctggcccctgacgcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcgtggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaata

SEQ ID NO: 30300 - DNA, 1245 bp, Homo sapiens
acagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcgtggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagagaataaaa

SEQ ID NO: 30301 - DNA, 1282 bp, Homo sapiens
ggctgctgcagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcgtggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagagaataaaa

SEQ ID NO: 30302 - DNA, 1386 bp, Homo sapiens
tttccacatgtgaggggctgaggggctcaaggaggggagcatctccactgggtggaggctgggggtcccagcaggaagtggtgagacaaagggcgctggctggcagggagacagcacaggaaggtcctagagcttcctcagtgcagctggactctcctggagaccttcacacaccctgacatctgggccttgcccgacgagggtgctttcactggtctgcaccatggcccaggccctgggattttgaacagctccgcaggtgaatgaaaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcgtggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaattttt

SEQ ID NO: 30303 - DNA, 1871 bp, Homo sapiens
cgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcgtggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaattttt

SEQ ID NO: 30304 - DNA, 1090 bp, Homo sapiens
acactgacctaagaaaccctcagcacagacaacacccctgcattccccacacaacacccacactcagccactgcgggcgaggagggcacaaggccaggttcccaagagctcaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcagggatggagactctgaaaaacacaccagccccacgactcctgaagacacacctgcccctggctctgctcccccagactctgttggatcagaaggtcaaggtggtctatgttgcccgcaacgcaaaggatgtggcggtttcctactaccacttctaccacatggccaaagtgtaccctcaccctgggacctgggaaagcttcctggagaagttcatggctggagaagtgtcctatgggtcctggtaccagcacgtgcaagagtggtgggagctgagccgcacccaccctgttctctacctcttctatgaagacatgaaggagaaccccaaaagggagattcaaaagatcctggagtttgtggggcgctccctgccagaggagactgtggacctcatggttgagcacacgtcgttcaaggagatgaagaagaaccctatgaccaactacaccaccgtccgccgggagttcatggaccacagcatctcccccttcatgaggaaaggcatggctggggactggaagaccaccttcaccgtggcgcagaatgagcgcttcgatgcggactatgcgaagaagatggcaggctgcagcctcagcttccgctctgagctgtgagaggggttcctggagtcactgcagagggagtgtgcgaatcaagcctgaccaagaggctccagaataaagtatgatttgtgttcaa

SEQ ID NO: 30305 - DNA, 1322 bp, Homo sapiens
gtttgtcctggagcccagatggactgtggccgggcaagtggatcacaggcctggccagcctaggagttgccacatgtgaggggccgaggggctcaaggaggggaacatcggggagaggagcctactgggtggaggctgggggtcccagcaggaaatggtgagacaaagggcgctggctggcaggaagacagcacaggaaggtcctagaggttcctcagtgcagctggactctcctggagaccttcacacaccctgacatctgggccccgcgccacgagggtgctttcactggtctgcaccatggcccaggccctgggattttgaacagctccgcaggtgaatgaaaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcagggatggagactctgaaaaacacaccagccccacgactcctgaagacacacctgcccctggctctgctcccccagactctgttggatcagaaggtcaaggtggtctatgttgcccgcaacgcaaaggatgtggcggtttcctactaccacttctaccacatggccaaagtgtaccctcaccctgggacctgggaaagcttcctggagaagttcatggctggagaagtgtcctatgggtcctggtaccagcacgtgcaagagtggtgggagctgagccgcacccaccctgttctctacctcttctatgaagacatgaaggagaaccccaaaagggagattcaaaagatcctggagtttgtggggcgctccctgccagaggagactgtggacctcatggttgagcacacgtcgttcaaggagatgaagaagaaccctatgaccaactacaccaccgtccgccgggagttcatggaccacagcatctcccccttcatgaggaaaggcatggctggggactggaagaccaccttcaccgtggcgcagaatgagcgcttcgatgcggactatgcgaagaagatggcaggctgcagcctcagcttccgctctgagctgtgagaggggttcctggagtcactgcagagggagtgtgcgaatcaagcctgaccaagaggctccagaataaagtatgatttgtgttc

SEQ ID NO: 30306 - DNA, 773 bp, Homo sapiens
agacagcacaggaaggtcctagaggttcctcagtgcagctggactctcctggagaccttcacacaccctgacatctgggccccgcgccacgagggtgctttcactggtctgcaccatggcccaggccctgggattttgaacagctccgcaggtgaatgaaagggaacgggcctggctctggcccctgacgcaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcagggatggagactctgaaaaacacaccagccccacgactcctgaagacacacctgcccctggctctgctcccccagactctgttggatcagaaggtcaaggtggtctatgttgcccgcaacgcaaaggatgtggcggtttcctactaccacttctaccacatggccaaagtgtaccctcaccctgggacctgggaaagcttcctggagaagttcatggctggagaagtgtcctatgggtcctggtaccagcacgtgcaagagtggtgggagctgagccgcacccaccctgttctctacctcttc

SEQ ID NO: 30307 - DNA, 2795 bp, Homo sapiens
agcttcgaggccagtgggaggagggaggggccaggcagctgagggccaggaaagatgtgaaaaactctagctggtgaccgagaggaggagtagagtgtgcccttagttcatatgaactagagggagttggtatttgcacagcagtcagggtcacatgagtgatcatggtacagtgagaagttctccctcccagggccaggtcacagggtttgtttctgttcaatccggattcttccagtaaaagcttcaacttcccacactgaagctgagagcctcccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctggtgtggaaaaagccaaagcaatgccctctccacggatactaaagactcacctttccactcagctgctgccaccgtctttctgggaaaacaactgcaagttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgtatgacttgagtacaaaaggattgttttaatccccattattctggaaagtgcatcctagtctcccagtctataacatcataataccttgagtataagtccaaatattaggttatatctatattaaaaacaaaatttctgtcatctgtcctggccattcaggcaactccagcctgggctcaatcctggagttctgtctggtcactatcagaaggaacactttgagggaaaccctggtgcagccagccctgaggaaacatggcctgagtgccctcactggtgggtgggaataaaatggaagtgcacagaggagatgtcagaagaccaaaacttggtgaatagtcccagtgctaggtcatataggaaacagaaagcatgacagtggccttttgggaacccaagttacgtcctggtgaaagcagaaaggaggagacaggatggctgtcaacaacgtcagcatgggcatggctcccaggcatggaggtaattgggtcttggcttcaatgccacccttttgggaagccctaaaccaagtgaggtgttcttttcccttgcttcccatatttgtcccagttgcagccctgttgttatgtatttactcttcaatttcttatttatacctctcactcaattgttaattctttgggttcagtctcatgccatatttactcctagtacctaatgcagtgcctggcacacagcaagtgcccttgagaacttgtagagggagtaaaaaagtgcatggataaatgactgcagcaaatcacaaattttgaactttgacccttttcttttagtcccaaatagtggcattccatagctgagggtagtaggagcagttcaccctgggagcagacaataagaggaagaatgaagccaactaaaattctgaatgctttttgttggatttcgtagggtattttttttaaaatagggtcttgctatgttgcccaggctggtcttaactgactgctttttattattaccatgcactggcaattccaaacaatgtcagtgttaaaatgcttctccctgaaaaagagaaaaaaaaaaggaaaaaaagaaaagaaaagtgaaaagaaaaactcttattggcctaagttctaaataatagctaggttaccactgagttttaactatatgtatatgagcttcaaataagcacctttttattatgtaaataaataaaagttatctgtatcccca

SEQ ID NO: 30308 - DNA, 2828 bp, Homo sapiens
agcttcgaggccagtgggaggagggaggggccaggcagctgagggccaggaaagatgtgaaaaactctagctggtgaccgagaggaggagtagagtgtgcccttagttcatatgaactagagggagttggtatttgcacagcagtcagggtcacatgagtgatcatggtacagtgagaagttctccctcccagggccaggtcacagggtttgtttctgttcaatccggattcttccagtaaaagcttcaacttcccacactgaagctgagagcctcccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctgagacaggatttcaccatgttgcccaggctggtctcaaactcctgagctcaagcaatccacctgcctcaacctcccaaagtgccaagattacagacctgctgccaccgtctttctgggaaaacaactgcaagttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgtatgacttgagtacaaaaggattgttttaatccccattattctggaaagtgcatcctagtctcccagtctataacatcataataccttgagtataagtccaaatattaggttatatctatattaaaaacaaaatttctgtcatctgtcctggccattcaggcaactccagcctgggctcaatcctggagttctgtctggtcactatcagaaggaacactttgagggaaaccctggtgcagccagccctgaggaaacatggcctgagtgccctcactggtgggtgggaataaaatggaagtgcacagaggagatgtcagaagaccaaaacttggtgaatagtcccagtgctaggtcatataggaaacagaaagcatgacagtggccttttgggaacccaagttacgtcctggtgaaagcagaaaggaggagacaggatggctgtcaacaacgtcagcatgggcatggctcccaggcatggaggtaattgggtcttggcttcaatgccacccttttgggaagccctaaaccaagtgaggtgttcttttcccttgcttcccatatttgtcccagttgcagccctgttgttatgtatttactcttcaatttcttatttatacctctcactcaattgttaattctttgggttcagtctcatgccatatttactcctagtacctaatgcagtgcctggcacacagcaagtgcccttgagaacttgtagagggagtaaaaaagtgcatggataaatgactgcagcaaatcacaaattttgaactttgacccttttcttttagtcccaaatagtggcattccatagctgagggtagtaggagcagttcaccctgggagcagacaataagaggaagaatgaagccaactaaaattctgaatgctttttgttggatttcgtagggtattttttttaaaatagggtcttgctatgttgcccaggctggtcttaactgactgctttttattattaccatgcactggcaattccaaacaatgtcagtgttaaaatgcttctccctgaaaaagagaaaaaaaaaaggaaaaaaagaaaagaaaagtgaaaagaaaaactcttattggcctaagttctaaataatagctaggttaccactgagttttaactatatgtatatgagcttcaaataagcacctttttattatgtaaataaataaaagttatctgtatcccca

SEQ ID NO: 30309 - DNA, 1359 bp, Homo sapiens
ccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcagggacaacgtggattcaggaaattgtggatatgattgaacagaatggggacgtggagaagtgccagcgagccatcatccaacaccgccatcctttcattgagtgggctcggccaccccaaccttctgtgcttgtactacgcagatgtttcctcttgagctattttaaaggtgtggaaaaagccaaagcaatgccctctccacggatactaaagactcacctttccactcagctgctgccaccgtctttctgggaaaacaactgcaagttcctttatgtagctcgaaatgccaaagactgtatggtttcctactaccatttccaaaggatgaaccacatgcttcctgaccctggtacctgggaagagtattttgaaaccttcatcaatggaaaagtggtttggggttcctggtttgaccacgtgaaaggatggtgggagatgaaagacagacaccagattctcttcctcttctatgaggacataaagagggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgta

SEQ ID NO: 30310 - DNA, 1987 bp, Homo sapiens
acaacaaacatgtgacatgctgggacaaggttaaagatcgttttatccttgctgtaaaagctgatctgcctgtagctgccacagcctccagcggtggctacagttgaaaccctcacaccacgcaggaagaggtcatcatcatgtcggacgatttcttatggtttgaaggcatagctttccctactatgggtttcagatccgaaaccttaagaaaagtacgtgatgagtttgtgataagggatgaagatgtaataatattgacttaccccaaatcaggaacaaactggttggctgagattctctgcctgatgcactccaagggggatgccaagtggatccaatctgtgcccatctgggagcgatcaccctgggtagagagtgagattgggtatacagcactcagtgaaacggagagtccacgtttattctcctcccacctccccatccagttattccccaagtctttcttcagttccaaggccaaggtgatttatctcatgagaaatcccagagatgttttggtgtctggttattttttctggaaaaacatgaagtttattaagaaaccaaagtcatgggaagaatattttgaatggttttgtcaaggaactgtgctatatgggtcatggtttgaccacattcatggctggatgcccatgagagaggagaaaaacttcctgttactgagttatgaggagctgaaacaggacacaggaagaaccatagagaagatctgtcaattcctgggaaagacgttagaacccgaagaactgaacttaattctcaagaacagctcctttcagagcatgaaagaaaacaagatgtccaattattccctcctgagtgttgattatgtagtggacaaagcacaacttctgagaaaaggtgtatctggggactggaaaaatcacttcacagtggcccaagctgaagactttgataaattgttccaagagaagatggcagatcttcctcgagagctgttcccatgggaataacgtccaaaacactctggatcttatatggagaatgacattgattctcctgtccttgtacatgtacctgactggggtcattgtgtaagacttattattttatcctgaaaccttaaatatcaaacctctgcatctctgatcccttccttgttaaaagttaccagggttggccaggcacggtggttcatgcctgtaatcccagcactatgggaggccgagacgggcggatcacgaggtcaggagactgagaccatcctggctaacacggtgaaaccccatctctactaaaaatacaaaaaccaaaaaaaattagccaggcgcattggctcatgtctgtaatcccagcactttgggaggtcgggggggtgggggaggatcacggggtcaggagatcgagaccatcctggccaacatgatgaaaccctatctctactaaaaatacaaaaattagccgggcatggtggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttcagagaaccagggttcaaagcccagggatgcaaaggttgcagtgagttgagtcatgggatcccagacttttttaaatgtttgcaatgtttcccgtttacagaatgctacaagaataatgtacgtactacctaaaaggatgtctaaatgtttgttaataaaaataagaaatagctacagtgacagattttagagcaaaaattagtaataaaaataagaaataaaattacaggagcaattaaggttccatttcttttcatcacatgtatctccacaatttattattgctctgatcttaaggagtgtaatttgcaatctaattttatcctcttactctgtgttgttaaaccatatacaataaacggtgtttatggag

SEQ ID NO: 30311 - DNA, 1199 bp, Homo sapiens
agacgctgtcgctgcgcacacctggcctctgtgccgcctgctccctgctcgtcctcccctccccaccctcacccacctgccatggacgggcccgccgagccccagatcccgggcttgtgggacacctatgaagatgacatctcggaaatcagccagaagttgccaggtgaatacttccggtacaagggcgtccccttccccgtcggcctgtactcgctcgagagcatcagcttggcggagaacacccaagatgtgcgggacgacgacatctttatcatcacctaccccaagtcaggcacgacctggatgatcgagatcatctgcttaatcctgaaggaaggggatccatcctggatccgctccgtgcccatctgggagcgggcaccctggtgtgagaccattgtgggtgccttcagcctcccggaccagtacagcccccgcctcatgagctcccatcttcccatccagatcttcaccaaggccttcttcagctccaaggccaaggtgatctacatgggccgcaacccccgggacgttgtggtctccctctatcattactccaagatcgccgggcagttaaaggacccgggcacacccgaccagttcctgagggacttcctcaaaggcgaagtgcagtttggctcctggttcgaccacattaagggctggcttcggatgaagggcaaagacaacttcctatttatcacctacgaggagctgcagcaggacttacagggctccgtggagcgcatctgtgggttcctgggccgtccgctgggcaaggaggcactgggctccgtcgtggcacactcaaccttcagcgccatgaaggccaacaccatgtccaactacacgctgctgcctcccagcctgctggaccaccgtcgcggggccttcctccggaaaggggtctgcggcgactggaagaaccacttcacggtggcccagagcgaagccttcgatcgtgcctaccgcaagcagatgcgggggatgccgaccttcccctgggatgaagacccggaggaggacggcagcccagatcctgagcccagccctgagcctgagcccaagcccagccttgagcccaacaccagcctggagcgtgagcccagacccaactccagccccagccccagccccggccaggcctctgagaccccgcacccacgaccctcataataaacacgtcgattctgtcc

SEQ ID NO: 30312 - DNA, 1252 bp, Homo sapiens
ctcccaaagtgctgggattacaggagtgtgccactgcgcctgaccagctttataaagtttatagggacagtgtcaccactttacagaagagggactgaggctctgaggaggaagttccttgccagggtccgagtgtcgccaccctgagaactccagcacccacctccctactctccctcatggcgtctcccccacctttccacagccagaagttgccaggtgaatacttccggtacaagggcgtccccttccccgtcggcctgtactcgctcgagagcatcagcttggcggagaacacccaagatgtgcgggacgacgacatctttatcatcacctaccccaagtcaggcacgacctggatgatcgagatcatctgcttaatcctgaaggaaggggatccatcctggatccgctccgtgcccatctgggagcgggcaccctggtgtgagaccattgtgggtgccttcagcctcccggaccagtacagcccccgcctcatgagctcccatcttcccatccagatcttcaccaaggccttcttcagctccaaggccaaggtgatctacatgggccgcaacccccgggacgttgtggtctccctctatcattactccaagatcgccgggcagttaaaggacccgggcacacccgaccagttcctgagggacttcctcaaaggcgaagtgcagtttggctcctggttcgaccacattaagggctggcttcggatgaagggcaaagacaacttcctatttatcacctacgaggagctgcagcaggacttacagggctccgtggagcgcatctgtgggttcctgggccgtccgctgggcaaggaggcactgggctccgtcgtggcacactcaaccttcagcgccatgaaggccaacaccatgtccaactacacgctgctgcctcccagcctgctggaccaccgtcgcggggccttcctccggaaaggggtctgcggcgactggaagaaccacttcacggtggcccagagcgaagccttcgatcgtgcctaccgcaagcagatgcgggggatgccgaccttcccctgggatgaagacccggaggaggacggcagcccagatcctgagcccagccctgagcctgagcccaagcccagccttgagcccaacaccagcctggagcgtgagcccagacccaactccagccccagccccagccccggccaggcctctgagaccccgcacccacgaccctcataataaacacgtcgattctgtcc

SEQ ID NO: 30313 - DNA, 2533 bp, Homo sapiens
atgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctattctg

SEQ ID NO: 30314 - DNA, 2388 bp, Homo sapiens
atgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctattctg

SEQ ID NO: 30315 - DNA, 2318 bp, Homo sapiens
atgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctattctg

SEQ ID NO: 30316 - DNA, 2210 bp, Homo sapiens
gtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagaattgtttcctagaattgttgagagggtttatgcccagagacatcccagaagcactgaacgcactcatgccaagatgttaatacctttcctcactaaagagaaaccagggttccttggagaaatggctgtttccagatctggggtaggaaaattacagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttagg

SEQ ID NO: 30317 - DNA, 941 bp, Homo sapiens
actccgggcgtgctgccggcggcggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatac

SEQ ID NO: 30318 - DNA, 4838 bp, Homo sapiens
gtggccgccggtggccgttaggctacctgaggccgttccttctggtctctctctcctgggccgcggagagaccgtctccctgccgttacagcaggccccatcccagcgcccagccgtacttggggaaaggccggttgcgattccggggctttcccgccagagctgggtcttctctggggagagctgttttcaccgggaagctcggctttctgtggtaccggcttcatctcccgccttccttgagacccgagtgatatttcttgactacttctgcgtctcacgtaaacatttctccaactctcctactctgtggtatctccctgagatgtgatatcgctagtgccaccatcagaaagaaacgtctggaccctcctgctcaggttatgaaaatccccttaactgccacaatttgcttacctggctcatcgcctcctggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccaggagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtgaagactgtctcacttagcagaccttgaccatgtgggggaccagctctttgttgtctacagccagagaccttggaaacagctgctcccagccctctgctgttgtaacacccttgatcctggaccaggccctggcgagatgcattcacaagcacatctgcctttccttttgtatctcagatactatttttgcaaagaaactttggtgctgtgaaaggggtgagggacatccctaagctgaagagagagactgcttttcacttcttcagttctgccatcttgttttcaaagggctccagcctcactcagtccctaattatgggactgagaaaagcttggaaagaatcttggtttcatataaattcttgttgttaggccttactaagaagtaggaaagggcatgggcaaaaggtagggataaaaaccaccagcatatacatggacatacacacacacccacacacacaaacacacacacacacacaattttcacgatgtatggtcaggaatgtgactgtaaactggactttggggcccaggcataagtcccttcctccaggacctttcctatttatatgtccctatacaaaatccatctgcttttatacgtagctgttttatcatctgtagcttcatcctatccggaggcacagcacatgagccctggacaggtcccaaagttccaagcagtcctttccgtgaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgcattttatggcccaaaggcatgttattaatatcttatgtaatttactttaaactaaataagacttttttctcctgtgt

SEQ ID NO: 30319 - DNA, 4969 bp, Homo sapiens
gtggccgccggtggccgttaggctacctgaggccgttccttctggtctctctctcctgggccgcggagagaccgtctccctgccgttacagcaggccccatcccagcgcccagccgtacttggggaaaggccggttgcgattccggggctttcccgccagagctgggtcttctctggggagagctgttttcaccgggaagctcggctttctgtggtaccggcttcatctcccgccttccttgagacccgagtgatatttcttgactacttctgcgtctcacgtaaacatttctccaactctcctactctgtggtatctccctgagatgtgatatcgctagtgccaccatcagaaagaaacgtctggaccctcctgctcaggttatgaaaatccccttaactgccacaatttgcttacctggctcatcgcctcctggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcaggcccaggcctgggagtgcttgcaagatatagttggggtaaaatgttgacttttggtggacaccacggagtcacattgatgcagataaggcacatggctgtggcaggattcagctccttcatcaattttcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccaggagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtgaagactgtctcacttagcagaccttgaccatgtgggggaccagctctttgttgtctacagccagagaccttggaaacagctgctcccagccctctgctgttgtaacacccttgatcctggaccaggccctggcgagatgcattcacaagcacatctgcctttccttttgtatctcagatactatttttgcaaagaaactttggtgctgtgaaaggggtgagggacatccctaagctgaagagagagactgcttttcacttcttcagttctgccatcttgttttcaaagggctccagcctcactcagtccctaattatgggactgagaaaagcttggaaagaatcttggtttcatataaattcttgttgttaggccttactaagaagtaggaaagggcatgggcaaaaggtagggataaaaaccaccagcatatacatggacatacacacacacccacacacacaaacacacacacacacacaattttcacgatgtatggtcaggaatgtgactgtaaactggactttggggcccaggcataagtcccttcctccaggacctttcctatttatatgtccctatacaaaatccatctgcttttatacgtagctgttttatcatctgtagcttcatcctatccggaggcacagcacatgagccctggacaggtcccaaagttccaagcagtcctttccgtgaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgcattttatggcccaaaggcatgttattaatatcttatgtaatttactttaaactaaataagacttttttctcctgtgt

SEQ ID NO: 30320 - DNA, 4726 bp, Homo sapiens
cctgctgtccggtggccgcgctgtggccgccggtggccgttaggctacctgaggccgttccttctggtctctctctcctgggccgcggagagaccgtctccctgccgttacagcaggccccatcccagcgcccagccgtacttggggaaaggccggttgcgattccggggctttcccgccagagctgggtcttctctggggagagctgttttcaccgggaagctcggctttctgtggtaccggcttcatctcccgccttccttgagacccgagtgatatttcttgactacttctgcgtctcacgtaaacatttctccaactctcctactctgtggtatctccctgagatgtgatatcgctagtgccaccatcagaaagaaacgtctggaccctcctgctcaggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtgaagactgtctcacttagcagaccttgaccatgtgggggaccagctctttgttgtctacagccagagaccttggaaacagctgctcccagccctctgctgttgtaacacccttgatcctggaccaggccctggcgagatgcattcacaagcacatctgcctttccttttgtatctcagatactatttttgcaaagaaactttggtgctgtgaaaggggtgagggacatccctaagctgaagagagagactgcttttcacttcttcagttctgccatcttgttttcaaagggctccagcctcactcagtccctaattatgggactgagaaaagcttggaaagaatcttggtttcatataaattcttgttgttaggccttactaagaagtaggaaagggcatgggcaaaaggtagggataaaaaccaccagcatatacatggacatacacacacacccacacacacaaacacacacacacacacaattttcacgatgtatggtcaggaatgtgactgtaaactggactttggggcccaggcataagtcccttcctccaggacctttcctatttatatgtccctatacaaaatccatctgcttttatacgtagctgttttatcatctgtagcttcatcctatccggaggcacagcacatgagccctggacaggtcccaaagttccaagcagtcctttccgtgaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgca

SEQ ID NO: 30321 - DNA, 2260 bp, Homo sapiens
attccgagtacgagaaagcgaaaaagcccagactgaaaagggtactgagaaattacgactagtcttaaatgctcccttcgcttctcgggcctcgccacaccgcgcaggcgccccactggtccttaactctgttctttgacctcctgccccagccccctcctcttcagccacctagcgactcttccggtgctgtgaaggcggttccggttcgcggcggttcccgggttttgcgttccgcgcccggccggaaaccccttcgcatggcagccggttccggttcggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccaggagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtga

SEQ ID NO: 30322 - DNA, 1932 bp, Homo sapiens
atggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtga

SEQ ID NO: 30323 - DNA, 4088 bp, Homo sapiens
gaggccgttccttctggtctctctctcctgggccgcggagagaccgtctccctgccgttacagcaggccccatcccagcgcccagccgtacttggggaaaggccggttgcgattccggggctttcccgccagagctgggtcttctctggggagagctgttttcaccgggaagctcggctttctgtggtaccggcttcatctcccgccttccttgagacccgagtgatatttcttgactacttctgcgtctcacgtaaacatttctccaactctcctactctgtggtatctccctgagatgtgatatcgctagtgccaccatcagaaagaaacgtctggaccctcctgctcaggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccaggagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtgaagactgtctcacttagcagaccttgaccatgtgggggaccagctctttgttgtctacagccagagaccttggaaacagctgctcccagccctctgctgttgtaacacccttgatcctggaccaggccctggcgagatgcattcacaagcacatctgcctttccttttgtatctcagatactatttttgcaaagaaactttggtgctgtgaaaggggtgagggacatccctaagctgaagagagagactgcttttcacttcttcagttctgccatcttgttttcaaagggctccagcctcactcagtccctaattatgggactgagaaaagcttggaaagaatcttggtttcatataaattcttgttgttaggccttactaagaagtaggaaagggcatgggcaaaaggtagggataaaaaccaccagcatatacatggacatacacacacacccacacacacaaacacacacacacacacaattttcacgatgtatggtcaggaatgtgactgtaaactggactttggggcccaggcataagtcccttcctccaggacctttcctatttatatgtccctatacaaaatccatctgcttttatacgtagctgttttatcatctgtagcttcatcctatccggaggcacagcacatgagccctggacaggtcccaaagttccaagcagtcctttccgtgaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatata

SEQ ID NO: 30324 - DNA, 6308 bp, Homo sapiens
gcaggcggaagggcgcggaggaggtgacgcgataggccagcgccggcgtcgcggcagccgcttcagaggaagctcggcggctgtggccgcggcgaacaggccggacgcctcgtcgctggcggggcttcccttggagctgacgaaggcggggtccgcggtccaggctgctgccgcgacggggccggcggcggggcagctgccaggaacgagggtagcagctgcatccagatctcattatgcatcagaaaaatgaaaaaacagaggaaaattctatggaggaaaggaatccacttagccttttctgagaaatggaatactgggtttggaggctttaagaagttttattttcaccaacacttgtgcattctgaaagctaagctgggaaggccagttacttggaatagacagttgagacatttccagggtagaaagaaagctcttcaaatccagaaaacgtggatcaaggatgaacccctttgtgctaagaccaagttcaatgtggctactcaaaatgttagtactttgtcctctaaagtgaaaagaaaggacgctaaacacttcatttcctcctcaaagactctcctgagactccaagcagagaagctgttgtcatcagcaaagaattctgaccatgaatactgcagagagaaaaatctcttgaaggcagttactgactttccatcaaatagtgctttaggtcaggccaatggtcacagacctaggacagacccacaaccttctgactttcccatgaagttcaatggggagagccaaagtccaggtgagagtggcacgattgtggtcaccttgaacaaccataagagaaagggcttttgttacggctgctgccaagggccggagcaccacaggaatgggggacccttgattccaaaaaagttccaacttaaccaacatagaaggataaaattatctcctcttatgatgtatgagaaattatccatgattagatttcggtacaggattctcagatcccagcacttcagaaccaaaagcaaggtttgcaagctaagaaaagcccagcgaagctgggtacagaaagtcactggggaccatcaagagacccgtagggagaacggtgagggtggcagttgcagcccatttccttccccagaacctaaagacccttcttgtcggcatcagccgtactttccagatatggacagcagtgctgtggtgaaggggacgaactctcatgtgcctgattgccacactaaaggaagctctttcttgggcaaggagcttagtttagacgaagcattccctgaccaacagaatggcagtgccacaaacgcctgggaccagtcatcctgttcttctcctaagtgggagtgtacagagctgattcatgacatccccttaccagaacatcgttctaataccatgttcatttcagaaactgaaagagaaattatgactctgggtcaggaaaatcagacaagttctgtcagtgatgacagagtaaaactgtcagtgtctggagcagatacatctgtgagtagcgtagatgggcctgtgtcccaaaaggctgttcaaaatgagaactcataccagatggaggaggatggatctctcaagcagagcattcttagttctgagttgctggaccacccttactgtaaaagtccactggaggctcccttggtgtgcagtggactcaaactagaaaatcaagtaggaggtggaaagaacagtcagaaagcctctccagtggatgatgaacagctgtcagtctgtctttctggattcctagatgaggttatgaagaagtatggcagtttggttccactcagtgaaaaagaagtccttggaagattaaaagatgtctttaatgaagacttttctaatagaaaaccatttatcaatagggaaataacaaactatcgggccagacatcaaaaatgtaacttccgtatcttctataataaacacatgctggatatggacgacctggcgactctggatggtcagaactggctgaatgaccaggtcattaatatgtatggtgagctgataatggatgcagtcccagacaaagttcacttcttcaacagcttttttcatagacagctggtaaccaaaggatataatggagtaaaaagatggactaaaaaggtggatttgtttaaaaagagtcttctgttgattcctattcacctggaagtccactggtctctcattactgtgacactctctaatcgaattatttcattttatgattcccaaggcattcattttaagttttgtgtagagaatataagaaagtatttgctgactgaagccagagaaaaaaatagacctgaatttcttcagggttggcagactgctgttacgaagtgtattccacaacagaaaaacgacagtgactgtggagtctttgtgctccagtactgcaagtgcctcgccttagagcagcctttccagttttcacaagaagacatgccccgagtgcggaagaggatttacaaggagctatgtgagtgccggctcatggactgaaactcagcagggactctgggaagtctgaccaagttggagcagatggtttgttacttgaatctccaaacacttagttgaatttttacagatatttcagatcagtggtgttgggccactattgttacctcaaatttattttttgcccttattcatttctccagctaccatgtactattgtttaatgttcagtttggtttcatttttaattttatggttctgtgcgtcccccatatttaatatttattattcaaacgcatgcatatagacagagcatgcagtgaagagtattaaaaaaaaaagcttagtagatttggtgcagcttttgaaacttagttagacgtgaactgaatacaggtttcaaatttactcccagaacctaaaaatgcaagatgtttttgatacaacataactctgagaatagtaagtgttccctggggcattaagggtagctgggggtggttttgacaaatccagtcctgttttactttaccagcggcaactttcaccaacttccctctccaagtgagtcttagagagtgcagtccattccttttgaagggtgagatggaagtggtcgtaaactgactggtgtcttctgtttctggaggcacacttgtaagcacagtggctgctttgggaggagtaaggtgtgagaaaaagcaaccttggaggccagtaacaatgacagatttcaatcgtggttttaggaattataatacgtggcatacatctcataaaggcttttgctgggatattgaattccctgaatttttctgttttcgacctgttaaaaaaatcttaacatccatcaaactagtggtcaaacaaatgagaatgcagctgttctcagagtaatttttaagttgtcatttccctgtgttgcctcccaattggaagaagttaaggtttaccaaatgcatttctatttcaagggtatctgaaacgtaaacattcaaaactgaaggctgactgacttgagatgttttgcaggtggctggagagaagagggaaggtaatagagacaacttagtcccatgggagcgcagcaaccgtgtcaggttctttctcctgtcccattagtgacctcagtaacatgcagggtacgtctggcttctgcatggccagtgctgacactagcacagctgttcttctccttctgttgaacctcatcttctgaagaaaggccaagtggcccttgtccatacacttagctgcattaggatgaatatcacgcgtctcacatctttaatccagcctttcgtgacatgttggaaagatacatgtgaaacctacccagttaccctttctgaattgggaggaaaaccaaccaatgtatgtatgagaaactcagaagtctgaatagaaaaacaaagtaaatggcagaagattctcgagtttatgcccgcgtaggtttggagtgttgaaaaagctaaaatgtttagtttcacttggccctgaggtatggttgagaaggctgactgccagcagttgaggattgagtccgaccatgtttacatgcagggttcccaacaccagtggtgacactgggaagcagccccagcactttcctctcctgagtcctccagacccaaaatccttaatgtcaaaccaggtcagtgtttcttactgtgtttcaagtcgttaaaaagactgagagtagaggcactttatgctgctataggtggggttctgtcagcgttaggaaaaaatgacagtttagggtaaggaagatctcataatgagtttttcaaacataattatgcaaacatgagatttttcaaaacatgccagaaatttgcctctgattttttttttttttttttttttttttttgtgggggtgtggtataccaaagtagccagtcactgggctgtcagttcaaaatgtcttgtacttcagagtgaggaagtgtttcagttcctcagtgacagaacctggcatgcagaagagacagaattgttcctgtaagaaaatcaacgccgagagagagctgcccaaatccagtgactcttccacttccagtctcatgcttcatagggcaccttgaggtgtgctgcccagtgtggcttagactaaatgttgagtttgggttttttgtttttttttttttttgagtcagagtctcactgtccctcaggctggagtgcaatggcgcaatcttgcctcactgcaacctccacctcccaggttcaagcgattctcctgcctcagcctcccaagtagctgggattacaggtgtgtgccaccacgccccaccgatttttgtacttttagtagagacaggatttcaccatgttggccaggctggtcttgaactcctgacctcaagtgatctgcccgcctgggcctcccaaagtgctgggattacaggcgggagccaccgtgcctggccaatgttaagtattttaaaagtcattttaaaatatttgtcattgatgaaacttggtttcagcacacgtaattgctttccctctcttcttgtgattaggtgtaaacctctatttaactcaagtcctagattagaatgtcctttgtcctgatgtttgcagtaattgcttccttggttaataaagatatttttgaaatatactctggactgttggtgaaagaggcaggcatggctttactggtactagtttggcactgaactgtttgggtgcccatgaggtaggcagaccttatgctttttttttttgagacggagtcttgctctgttgcccaggctggagtgcagtgatgtgatctcggctcactgcaacccctgcctcccaggttcaagtgattctcctgcctcagcttccccaatagctgggactacaggtgtgcgccaccactcccagctaatttttgtatttttagtagagacagggttttgccatgttggtcaggctggtctcggaactcctgacctcaggtgatccacccgcctctgcctcacaaagtgctgggattacaggcatgagctaccgtgcctggcctaaaccttacgcttttgaggttgagtgcaggccttgtgataactaagcgctacttttgacgagccttcaacaagctgcccagtcctctcctcagcagacgcatcaggttgtagttgcatctttacagtggtctttccttttattaaatctatagcagtgaatatagatttgattcaacttttagttacgttctctcaagaatcctaatcaactttcagttagcctcttaagaaagggaaaaaaaggtgctgccagtcatccccaaattatgtttttggctgtgcattctattttctacatagcactgaatctgagtaacagtcatcctggatttatagttggaacagaacagtaacagacctaactgggactcagccagcactagcctcatcttagctgccccttttctctgctttgcagtttactgcttccctgggctagccataacggggttctgggcaggtcagactcttcagcaagacagtgtattaatagtgtgaattagatacactgatgacctgctctgcctagttaagaaactgaattaatcagcagttacaaagcacatactttgttacgtgctaggctttgcctcctggcctctagataattaagacggcccagggaataccagcagagaagtgctaattgtatttgggtgttacaaaagcagacctagacgagctgttcacttaactggtacctgttggtcagaaaaagaatttatttagagattatgatcatgtaaaattacagtactcaacccttctagcaaagtatttttttgaaaaataaactaaatgcctttataaa

SEQ ID NO: 30325 - DNA, 4644 bp, Homo sapiens
actaccttttctcttcggttggctgtagtttaaattctaaggtctcctcaagaaatgacattttcacatttcttaggcatctgtggtgccagaggagcaaacccatcgcacacgccaggtctgccatggggccctgggcggtggggattttggatgtaacgtgtctaggccgagcccgcgccgtgaaaggcctaccctgccgaaagcccgggcggcgggcgcccacaagtcagggctcggtgcggcgccgcagccagctctgcccgcgagccgagtccgggctgctgagggggagccgcgctgggggcggcggcgtcggggcgggggcgggagccgggcggcagctccagcgcccgtgggggaggagcggcagcggcggcggctggagctgctgtggcgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacgacactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagctgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacacaaataaaaagaaaatatttatagga

SEQ ID NO: 30326 - DNA, 6645 bp, Homo sapiens
cgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaaggcttttgagtaatcagattctgaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacgacactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagctgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacacaaataaaaagaaaatatttataggaggaaatgattaatttgatattctttagtgaacttgtttaattcctcagtgggtgtgacatatttcatgggaatattcaaatatctatggtaatattttgaccctttatatttgttctaaaataagtcaaaatgtgaaaataatattaaatctaagatattttgaactaagcatctttatatgcttgtgtaacaggaacaaagtaacagcctttcaattcatatactgccttgtgttcagtgaacccaagaaatgtaataaatatttgtaattttacacaaatatttaagaggaaagagtattaagagcaattcaaaaaaagtaaccttatactactaaaaaaaaaattcttgcatatattatcatcaaatgcatttttgaagacatcaaagactcaggttaaaactattttggtaagtgcagcttgaatttcaaatatcccgtgttacctttctctattacagcttaaagtatgctacaatctgtgtcatatagttaattgataagcatttttaatctgtgtaaacacaggaatttaaataggaatttactatttttttataaagcttttgctattttttcattgctcattttgttcttattattttgataaagtatcagactttttgcttgagttcttcagtgtaaattattttttacatgtaaaagtactgtattcaaccagttgcataatacagcaaaaatctttgaattcccctttaaaataactaaaatttgatggtttccatgacagatttatagcacatatagggatcttgcatgtatctgcagaaacttcattatttttcaaatgaaatggtgtatacttctttcaaatgaactttgagacttgaaacatattttagtcattttttgttaaatattgaatttttaaatacacatatatcaaaaatagttgagaataaaaagaaagcctaatcatcagcaattattttatttttaatttggccatctctgacattgcagtcaatatcttagggtattttcttgaatttaataaagtcccatgggtgggttcagggtgaatgggagtattaacaacaaccaaaaaatatctattgagacacagtagagtctcagtaagagaaatattaaaatgtaagaaaggtcaccattagtgatatcaactgtagtttgttactttgaactatatttctgattaactctttatagtaataacttagagctgttagctcagatatcttaattagctcatatgaaaaacaagtttaattttattatttactgaacatggcaaaatgcttttcaatctataataaaactgggataaaaaattgaagttgttttttttaaaacctaatagcaataagcaaaattggcatacataatttttttaatgaactatattttgtcagaatctgaaggtactgaaaaactattctaaaatgcctacttgtttttgcattaatttgtaatgcttacattttgcacccttagataatgtttgataagataaaaatataatttatcccttgtaccaactcaagtcaatcagattttaacatgaaaaatatagattaatgtatgtcagctttctagaggtagaatactcagctatttgatggcatttttcccaccccatgtgaaattttatttttggaagttatgctagtgacattgcaatatatattgaaatcttcggaggctgccaggttgagcttcaaaactagacttgagaatctttcgtgtatatgcacattcacttgataattgtgtattctatgtagtttaaagtgggatcaagccttttaaaatgtgttattagtacttagaagttgtaaaacagaacttatagaggtttgttactagacactgaaactgcatgacaagtatctggtgtcttaactaattagatagatctgttgtattggttttcttgttggatagaataacagttaatcatttttagaagagttttagattacttgccataaaatttgtatgtctcagctcttgttggtttaggagcagaagtggtgtttagtcccttcccgttaatgttgctgtgctacttcagacagctgaaaacttaatggtattatttcaagttcacataaccctaaaaaaggttttctttgtgtagtaacttgtgcttaaacttttagtcaattaaatgtaggaggttttatttgaaaacataaaatgattctctaaattacatcttgttttaagccaccaaaatgaatgcagtaatttttctttaaaaaaatgatctctgaaaactgtgagacaatgtaaaaagaataagttttaattcccccaaaatcaaaaattgtacttaaaatctcagacaattcactgaacaggaataataaagaacatattttaatatataa

SEQ ID NO: 30327 - DNA, 6501 bp, Homo sapiens
ggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaagcagtctggaccgaaaagaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacgacactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagctgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacacaaataaaaagaaaatatttataggaggaaatgattaatttgatattctttagtgaacttgtttaattcctcagtgggtgtgacatatttcatgggaatattcaaatatctatggtaatattttgaccctttatatttgttctaaaataagtcaaaatgtgaaaataatattaaatctaagatattttgaactaagcatctttatatgcttgtgtaacaggaacaaagtaacagcctttcaattcatatactgccttgtgttcagtgaacccaagaaatgtaataaatatttgtaattttacacaaatatttaagaggaaagagtattaagagcaattcaaaaaaagtaaccttatactactaaaaaaaaaattcttgcatatattatcatcaaatgcatttttgaagacatcaaagactcaggttaaaactattttggtaagtgcagcttgaatttcaaatatcccgtgttacctttctctattacagcttaaagtatgctacaatctgtgtcatatagttaattgataagcatttttaatctgtgtaaacacaggaatttaaataggaatttactatttttttataaagcttttgctattttttcattgctcattttgttcttattattttgataaagtatcagactttttgcttgagttcttcagtgtaaattattttttacatgtaaaagtactgtattcaaccagttgcataatacagcaaaaatctttgaattcccctttaaaataactaaaatttgatggtttccatgacagatttatagcacatatagggatcttgcatgtatctgcagaaacttcattatttttcaaatgaaatggtgtatacttctttcaaatgaactttgagacttgaaacatattttagtcattttttgttaaatattgaatttttaaatacacatatatcaaaaatagttgagaataaaaagaaagcctaatcatcagcaattattttatttttaatttggccatctctgacattgcagtcaatatcttagggtattttcttgaatttaataaagtcccatgggtgggttcagggtgaatgggagtattaacaacaaccaaaaaatatctattgagacacagtagagtctcagtaagagaaatattaaaatgtaagaaaggtcaccattagtgatatcaactgtagtttgttactttgaactatatttctgattaactctttatagtaataacttagagctgttagctcagatatcttaattagctcatatgaaaaacaagtttaattttattatttactgaacatggcaaaatgcttttcaatctataataaaactgggataaaaaattgaagttgttttttttaaaacctaatagcaataagcaaaattggcatacataatttttttaatgaactatattttgtcagaatctgaaggtactgaaaaactattctaaaatgcctacttgtttttgcattaatttgtaatgcttacattttgcacccttagataatgtttgataagataaaaatataatttatcccttgtaccaactcaagtcaatcagattttaacatgaaaaatatagattaatgtatgtcagctttctagaggtagaatactcagctatttgatggcatttttcccaccccatgtgaaattttatttttggaagttatgctagtgacattgcaatatatattgaaatcttcggaggctgccaggttgagcttcaaaactagacttgagaatctttcgtgtatatgcacattcacttgataattgtgtattctatgtagtttaaagtgggatcaagccttttaaaatgtgttattagtacttagaagttgtaaaacagaacttatagaggtttgttactagacactgaaactgcatgacaagtatctggtgtcttaactaattagatagatctgttgtattggttttcttgttggatagaataacagttaatcatttttagaagagttttagattacttgccataaaatttgtatgtctcagctcttgttggtttaggagcagaagtggtgtttagtcccttcccgttaatgttgctgtgctacttcagacagctgaaaacttaatggtattatttcaagttcacataaccctaaaaaaggttttctttgtgtagtaacttgtgcttaaacttttagtcaattaaatgtaggaggttttatttgaaaacataaaatgattctctaaattacatcttgttttaagccaccaaaatgaatgcagtaatttttctttaaaaaaatgatctctgaaaactgtgagacaatgtaaaaagaataagttttaattcccccaaaatcaaaaattgtacttaaaatctcagacaattcactgaacaggaataataaagaacatattttaatata

SEQ ID NO: 30328 - DNA, 6192 bp, Homo sapiens
cgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatacgcaaaatacgtcattatgttctggaactgtagttcatggtagacgttttcatcatgctcatgcacagataccagtagtaaaaacagcagcccaaagtaatcagattctgaaagaatacccacctcatgtccaaaaagttgaaattaatcctgtaaggttaagtcggctccaaggtgttgtcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattgtaattataaagattttttttattacccacaagaaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagctgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacacaaataaaaagaaaatatttataggaggaaatgattaatttgatattctttagtgaacttgtttaattcctcagtgggtgtgacatatttcatgggaatattcaaatatctatggtaatattttgaccctttatatttgttctaaaataagtcaaaatgtgaaaataatattaaatctaagatattttgaactaagcatctttatatgcttgtgtaacaggaacaaagtaacagcctttcaattcatatactgccttgtgttcagtgaacccaagaaatgtaataaatatttgtaattttacacaaatatttaagaggaaagagtattaagagcaattcaaaaaaagtaaccttatactactaaaaaaaaaattcttgcatatattatcatcaaatgcatttttgaagacatcaaagactcaggttaaaactattttggtaagtgcagcttgaatttcaaatatcccgtgttacctttctctattacagcttaaagtatgctacaatctgtgtcatatagttaattgataagcatttttaatctgtgtaaacacaggaatttaaataggaatttactatttttttataaagcttttgctattttttcattgctcattttgttcttattattttgataaagtatcagactttttgcttgagttcttcagtgtaaattattttttacatgtaaaagtactgtattcaaccagttgcataatacagcaaaaatctttgaattcccctttaaaataactaaaatttgatggtttccatgacagatttatagcacatatagggatcttgcatgtatctgcagaaacttcattatttttcaaatgaaatggtgtatacttctttcaaatgaactttgagacttgaaacatattttagtcattttttgttaaatattgaatttttaaatacacatatatcaaaaatagttgagaataaaaagaaagcctaatcatcagcaattattttatttttaatttggccatctctgacattgcagtcaatatcttagggtattttcttgaatttaataaagtcccatgggtgggttcagggtgaatgggagtattaacaacaaccaaaaaatatctattgagacacagtagagtctcagtaagagaaatattaaaatgtaagaaaggtcaccattagtgatatcaactgtagtttgttactttgaactatatttctgattaactctttatagtaataacttagagctgttagctcagatatcttaattagctcatatgaaaaacaagtttaattttattatttactgaacatggcaaaatgcttttcaatctataataaaactgggataaaaaattgaagttgttttttttaaaacctaatagcaataagcaaaattggcatacataatttttttaatgaactatattttgtcagaatctgaaggtactgaaaaactattctaaaatgcctacttgtttttgcattaatttgtaatgcttacattttgcacccttagataatgtttgataagataaaaatataatttatcccttgtaccaactcaagtcaatcagattttaacatgaaaaatatagattaatgtatgtcagctttctagaggtagaatactcagctatttgatggcatttttcccaccccatgtgaaattttatttttggaagttatgctagtgacattgcaatatatattgaaatcttcggaggctgccaggttgagcttcaaaactagacttgagaatctttcgtgtatatgcacattcacttgataattgtgtattctatgtagtttaaagtgggatcaagccttttaaaatgtgttattagtacttagaagttgtaaaacagaacttatagaggtttgttactagacactgaaactgcatgacaagtatctggtgtcttaactaattagatagatctgttgtattggttttcttgttggatagaataacagttaatcatttttagaagagttttagattacttgccataaaatttgtatgtctcagctcttgttggtttaggagcagaagtggtgtttagtcccttcccgttaatgttgctgtgctacttcagacagctgaaaacttaatggtattatttcaagttcacataaccctaaaaaaggttttctttgtgtagtaacttgtgcttaaacttttagtcaattaaatgtaggaggttttatttgaaaacataaaatgattctctaaattacatcttgttttaagccaccaaaatgaatgcagtaatttttctttaaaaaaatgatctctgaaaactgtgagacaatgtaaaaagaataagttttaattcccccaaaatcaaaaattgtacttaaaatctcagacaattcactgaacaggaataataaagaacatattttaatatataa

SEQ ID NO: 30329 - DNA, 2043 bp, Homo sapiens
tacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagcatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacac

SEQ ID NO: 30330 - DNA, 4736 bp, Homo sapiens
ttttttttttttttttttttttttttttcctttcccctccccctccctctccaagccggaggggtcctgaggtgacagcgcctgcaactgaaatttcagcagcgggagaagatggacaagagaaagctcgggcgacggccatcttcatccgaaatcatcacagaaggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggatacccagagttatattgacgaatgtcctgggaacggagttaggaagaaaatacataaggaccccacctgtaactgagggaagtttgagtgatacagacaacttgcaatcagagcaactttcttcatcatctgatggcagcctagaatcttatcaaaatctaaaccctcacaagagctgttatttatctgaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatcaaaatctagtgaattcattttccttgaactacacaatcctgtttcacaaagagaagaattgaagctgaaagatattatgacggaaataagtataatcagtggagaattagagctttcttacccgttgtcttgggttcaggcatttcctttgtttcagaacctctcttcaaaagaaagttcttttattcattattactgtgtttcaacttgttctttccctgctggtgttgctgttgctgaagaaatgaagctgaaatcagtatctcagccctcaaacacagatgcggccaagcctacttacaccttcctgcagaagcaaagtagcggttgctactccctttctattacatctaatccagatgaagaatggcgagaagtcaggcacactggacttgttcagaagttgattgtatatcctccaccacctactaaggggggattaggagtaactaatgaagatctggagtgtttagaagaaggagagtttcttaatgatgtaatcattgatttttaccttaagtatcttatattggagaaggcatcagatgaacttgttgaacgaagtcacatttttagtagctttttctataaatgcttgacaagaaaggaaaataatttaacagaagataatccaaatctttcaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagctcacagagaagaaaataacttgcagtagttttataataagtcattggaacattatttaaaatatgtaggacacattattagaattgttgggatctcatagatggaatgggaatgggggtgatatagataaacttactagatataaattaaaattttataaatatttcatatttttctgagtaaatatgattggattatgcaacagcatatgtaatatgggaatgttttgtagataataaaacttacatgatctgtacttccacgtgactgggtgctgaggggagttaaagcctccctggtgccagccccagtgcttgtcaaatttgctgacaggtcacatcatattgtaattctattctttgcagctcaagcatgcagtatgaatactgtgtattttttaaaaaaataatttagtatcaaggcttcagaaaatgccatttacggcatcccttctgtatgtaacaaaaagacattcataatgttaggaagatgataaaaattcgctcttttaaagtgcagcttattattctcaattgctaaatacgattactctgctttttttttttcatttcttttgatgtcatatgtgagtatcttataatttagttcatttgttcagggtaaaatttgaaacaaaaaattttacctgtgcaaaatagttttttaaaaattatacatgtagctcaacttgaggtactgctatataaatattcactcacattatcacggaatttatgtatagtttctctaatatagaagataaaattggtgtcctcataactttaacaaagaaaaccctcagtcctatttattaatgggtagaattaaatatataattttatagctcagtttacccagtattcatctgcaaagccagattgctctcattgcttttatatttttaaattgtagcttttagagacctatgatcctcatggaacttaattttttattaaatattcaggtaacagttctgaattcatgtgataatggtggcattatatatgattaaacacttcagaactttctaatgttatcaggagtattttgagggagatatgattatattgtattttctcagataagaaaaatgttttttaacaatattattttaatctgttttaagcatctcttagatttacattataactacataaagcagtgaagcaaaggcaaattaagataaagctagaaagtctgaacattttatttcaaaatcatacgaatcggggtcagttaagcctcagtattcttagcttttgttgattttggcactatctttatattattaaatatatttgttgtttggatatttcatataaagatggctataattacatatttcattcccaatttgtgtgtgttggggggtacttttaaaggtgactattgttttgtacatctaattttgggaaagcaagtctataagacatcttgtgatttcttaatgtttttgtttgtatgtttttcaaagatatcactgtcctttatcatgttttgaagattgtttaaaattcattttcctaaattaatgtgcaagtaatgttttgaggatatcagtgttttatattaaacatatttccaattcattaaa

SEQ ID NO: 30331 - DNA, 3272 bp, Homo sapiens
ttttttttttcctttcccctccccctccctctccaagccggaggggtcctgaggtgacagcgcctgcaactgaaatttcagcagcgggagaagatggacaagagaaagctcgggcgacggccatcttcatccgataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggatacccagagttatattgacgaatgtcctgggaacggagttaggaagaaaatacataaggaccccacctgtaactgagggaagtttgagtgatacagacaacttgcaatcagagcaactttcttcatcatctgatggcagcctagaatcttatcaaaatctaaaccctcacaagagctgttatttatctgaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatcaaaatctagtgaattcattttccttgaactacacaatcctgtttcacaaagagaagaattgaagctgaaagatattatgacggaaataagtataatcagtggagaattagagctttcttacccgttgtcttgggttcaggcatttcctttgtttcagaacctctcttcaaaagaaagttcttttattcattattactgtgtttcaacttgttctttccctgctggtgttgctgttgctgaagaaatgaagctgaaatcagtatctcagccctcaaacacagatgcggccaagcctacttacaccttcctgcagaagcaaagtagcggttgctactccctttctattacatctaatccagatgaagaatggcgagaagtcaggcacactggacttgttcagaagttgattgtatatcctccaccacctactaaggggggattaggagtaactaatgaagatctggagtgtttagaagaaggagagtttcttaatgatgtaatcattgatttttaccttaagtatcttatattggagaaggcatcagatgaacttgttgaacgaagtcacatttttagtagctttttctataaatgcttgacaagaaaggaaaataatttaacagaagataatccaaatctttcaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagc

SEQ ID NO: 30332 - DNA, 4513 bp, Homo sapiens
cctttcccctccccctccctctccaagccggaggggtcctgaggtgacagcgcctgcaactgaaatttcagcagcgggagaagatggacaagagaaagctcgggcgacggccatcttcatccgaaatcatcacagaaggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatcaaaatctagtgaattcattttccttgaactacacaatcctgtttcacaaagagaagaattgaagctgaaagatattatgacggaaataagtataatcagtggagaattagagctttcttacccgttgtcttgggttcaggcatttcctttgtttcagaacctctcttcaaaagaaagttcttttattcattattactgtgtttcaacttgttctttccctgctggtgttgctgttgctgaagaaatgaagctgaaatcagtatctcagccctcaaacacagatgcggccaagcctacttacaccttcctgcagaagcaaagtagcggttgctactccctttctattacatctaatccagatgaagaatggcgagaagtcaggcacactggacttgttcagaagttgattgtatatcctccaccacctactaaggggggattaggagtaactaatgaagatctggagtgtttagaagaaggagagtttcttaatgatgtaatcattgatttttaccttaagtatcttatattggagaaggcatcagatgaacttgttgaacgaagtcacatttttagtagctttttctataaatgcttgacaagaaaggaaaataatttaacagaagataatccaaatctttcaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagctcacagagaagaaaataacttgcagtagttttataataagtcattggaacattatttaaaatatgtaggacacattattagaattgttgggatctcatagatggaatgggaatgggggtgatatagataaacttactagatataaattaaaattttataaatatttcatatttttctgagtaaatatgattggattatgcaacagcatatgtaatatgggaatgttttgtagataataaaacttacatgatctgtacttccacgtgactgggtgctgaggggagttaaagcctccctggtgccagccccagtgcttgtcaaatttgctgacaggtcacatcatattgtaattctattctttgcagctcaagcatgcagtatgaatactgtgtattttttaaaaaaataatttagtatcaaggcttcagaaaatgccatttacggcatcccttctgtatgtaacaaaaagacattcataatgttaggaagatgataaaaattcgctcttttaaagtgcagcttattattctcaattgctaaatacgattactctgctttttttttttcatttcttttgatgtcatatgtgagtatcttataatttagttcatttgttcagggtaaaatttgaaacaaaaaattttacctgtgcaaaatagttttttaaaaattatacatgtagctcaacttgaggtactgctatataaatattcactcacattatcacggaatttatgtatagtttctctaatatagaagataaaattggtgtcctcataactttaacaaagaaaaccctcagtcctatttattaatgggtagaattaaatatataattttatagctcagtttacccagtattcatctgcaaagccagattgctctcattgcttttatatttttaaattgtagcttttagagacctatgatcctcatggaacttaattttttattaaatattcaggtaacagttctgaattcatgtgataatggtggcattatatatgattaaacacttcagaactttctaatgttatcaggagtattttgagggagatatgattatattgtattttctcagataagaaaaatgttttttaacaatattattttaatctgttttaagcatctcttagatttacattataactacataaagcagtgaagcaaaggcaaattaagataaagctagaaagtctgaacattttatttcaaaatcatacgaatcggggtcagttaagcctcagtattcttagcttttgttgattttggcactatctttatattattaaatatatttgttgtttggatatttcatataaagatggctataattacatatttcattcccaatttgtgtgtgttggggggtacttttaaaggtgactattgttttgtacatctaattttgggaaagcaagtctataagacatcttgtgatttcttaatgtttttgtttgtatgtttttcaaagatatcactgtcctttatcatgttttgaagattgtttaaaattcattttcctaaattaatgtgcaagtaatgttttgaggatatcagtgttttatattaaacatatttccaattcattaaa

SEQ ID NO: 30333 - DNA, 1483 bp, Homo sapiens
actcagcccattgagttttaaaacctccctaatgacagatataacagttggagaattctgttaaggtttaatgacagtattttatatcatgcccagatggagctaagcaaaataagtagatttaactgtgtttatactaagttgcacagccagttttggaatctgaaaagcatttaataaattgctgcctttattctgtccatttcattattgtttatagttattaaatttaagaataaccaggggttactataaggagatatatttataatgtgttaaatatgatatatcttaaagaagatggttaaactaaatttaagatatttcaatatataaaaatggctcttgaagtccctatcttaaatgaaaaaatttttatatatcaaatctgtctttcatactctcagaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagctcacagagaagaaaataacttgcagtagttttataataagtcattggaacattatttaaaatatgtaggacacattattagaattgttgggatctcatagatggaatgggaatgggggtgatatagataaacttactagatataaattaaaattttataaatatttcatatttttctgagtaaatatgattggattatgcaacagcatatgtaatatgggaatgttttgtagataataaaacttacatgatctgtacttccacgtgactgggtgctgaggggagttaaagcctccctggtgccagccccagtgcttgtcaaatttgc

SEQ ID NO: 30334 - DNA, 4703 bp, Homo sapiens
ctccccctccctctccaagccggaggggtcctgaggtgacagcgcctgcaactgaaatttcagcagcgggagaagatggacaagagaaagctcgggcgacggccatcttcatccgaaatcatcacagaaggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatcaaaatctagtgaattcattttccttgaactacacaatcctgtttcacaaagagaagaattgaagctgaaagatattatgacggaaataagtataatcagtggagaattagagctttcttacccgttgtcttgggttcaggcatttcctttgtttcagaacctctcttcaaaagaaagttcttttattcattattactgtgtttcaacttgttctttccctgctggtgttgctgttgctgaagaaatgaagctgaaatcagtatctcagccctcaaacacagatgcggccaagcctacttacaccttcctgcagaagcaaagtagcggttgctactccctttctattacatctaatccagatgaagaatggcgagaagtcaggcacactggacttgttcagaagttgattgtatatcctccaccacctactaaggggggattaggagtaactaatgaagatctggagtgtttagaagaaggagagtttcttaatgatgtaatcattgatttttaccttaagtatcttatattggagaaggcatcagatgaacttgttgaacgaagtcacatttttagtagctttttctataaatgcttgacaagaaaggaaaataatttaacagaagataatccaaatctttcaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagctcacagagaagaaaataacttgcagtagttttataataagtcattggaacattatttaaaatatgtaggacacattattagaattgttgggatctcatagatggaatgggaatgggggtgatatagataaacttactagatataaattaaaattttataaatatttcatatttttctgagtaaatatgattggattatgcaacagcatatgtaatatgggaatgttttgtagataataaaacttacatgatctgtacttccacgtgactgggtgctgaggggagttaaagcctccctggtgccagccccagtgcttgtcaaatttgctgacaggtcacatcatattgtaattctattctttgcagctcaagcatgcagtatgaatactgtgtattttttaaaaaaataatttagtatcaaggcttcagaaaatgccatttacggcatcccttctgtatgtaacaaaaagacattcataatgttaggaagatgataaaaattcgctcttttaaagtgcagcttattattctcaattgctaaatacgattactctgctttttttttttcatttcttttgatgtcatatgtgagtatcttataatttagttcatttgttcagggtaaaatttgaaacaaaaaattttacctgtgcaaaatagttttttaaaaattatacatgtagctcaacttgaggtactgctatataaatattcactcacattatcacggaatttatgtatagtttctctaatatagaagataaaattggtgtcctcataactttaacaaagaaaaccctcagtcctatttattaatgggtagaattaaatatataattttatagctcagtttacccagtattcatctgcaaagccagattgctctcattgcttttatatttttaaattgtagcttttagagacctatgatcctcatggaacttaattttttattaaatattcaggtaacagttctgaattcatgtgataatggtggcattatatatgattaaacacttcagaactttctaatgttatcaggagtattttgagggagatatgattatattgtattttctcagataagaaaaatgttttttaacaatattattttaatctgttttaagcatctcttagatttacattataactacataaagcagtgaagcaaaggcaaattaagataaagctagaaagtctgaacattttatttcaaaatcatacgaatcggggtcagttaagcctcagtattcttagcttttgttgattttggcactatctttatattattaaatatatttgttgtttggatatttcatataaagatggctataattacatatttcattcccaatttgtgtgtgttggggggtacttttaaaggtgactattgttttgtacatctaattttgggaaagcaagtctataagacatcttgtgatttcttaatgtttttgtttgtatgtttttcaaagatatcactgtcctttatcatgttttgaagattgtttaaaattcattttcctaaattaatgtgcaagtaatgttttgaggatatcagtgttttatattaaacatatttccaattcattaaa

SEQ ID NO: 30335 - DNA, 4945 bp, Homo sapiens
ggaggggtcctgaggtgacagcgcctgcaactgaaatttcagcagcgggagaagatggacaagagaaagctcgggcgacggccatcttcatccgaaatcatcacagaaggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggatacccagagttatattgacgaatgtcctgggaacggagttaggaagaaaatacataaggaccccacctgtaactgagggaagtttgagtgatacagacaacttgcaatcagagcaactttcttcatcatctgatggcagcctagaatcttatcaaaatctaaaccctcacaagagctgttatttatctgaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatcaaaatctagtgaattcattttccttgaactacacaatcctgtttcacaaagagaagaattgaagctgaaagatattatgacggaaataagtataatcagtggagaattagagctttcttacccgttgtcttgggttcaggcatttcctttgtttcagaacctctcttcaaaagaaagttcttttattcattattactgtgtttcaacttgttctttccctgctggtgttgctgttgctgaagaaatgaagctgaaatcagtatctcagccctcaaacacagatgcggccaagcctacttacaccttcctgcagaagcaaagtagcggttgctactccctttctattacatctaatccagatgaagaatggcgagaagtcaggcacactggacttgttcagaagttgattgtatatcctccaccacctactaaggggggattaggagtaactaatgaagatctggagtgtttagaagaaggagagtttcttaatgatgtaatcattgatttttaccttaagtatcttatattggagaaggcatcagatgaacttgttgaacgaagtcacatttttagtagctttttctataaatgcttgacaagaaaggaaaataatttaacagaagataatccaaatctttcaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagctcacagagaagaaaataacttgcagtagttttataataagtcattggaacattatttaaaatatgtaggacacattattagaattgttgggatctcatagatggaatgggaatgggggtgatatagataaacttactagatataaattaaaattttataaatatttcatatttttctgagtaaatatgattggattatgcaacagcatatgtaatatgggaatgttttgtagataataaaacttacatgatctgtacttccacgtgactgggtgctgaggggagttaaagcctccctggtgccagccccagtgcttgtcaaatttgctgacaggtcacatcatattgtaattctattctttgcagctcaagcatgcagtatgaatactgtgtattttttaaaaaaataatttagtatcaaggcttcagaaaatgccatttacggcatcccttctgtatgtaacaaaaagacattcataatgttaggaagatgataaaaattcgctcttttaaagtgcagcttattattctcaattgctaaatacgattactctgctttttttttttcatttcttttgatgtcatatgtgagtatcttataatttagttcatttgttcagggtaaaatttgaaacaaaaaattttacctgtgcaaaatagttttttaaaaattatacatgtagctcaacttgaggtactgctatataaatattcactcacattatcacggaatttatgtatagtttctctaatatagaagataaaattggtgtcctcataactttaacaaagaaaaccctcagtcctatttattaatgggtagaattaaatatataattttatagctcagtttacccagtattcatctgcaaagccagattgctctcattgcttttatatttttaaattgtagcttttagagacctatgatcctcatggaacttaattttttattaaatattcaggtaacagttctgaattcatgtgataatggtggcattatatatgattaaacacttcagaactttctaatgttatcaggagtattttgagggagatatgattatattgtattttctcagataagaaaaatgttttttaacaatattattttaatctgttttaagcatctcttagatttacattataactacataaagcagtgaagcaaaggcaaattaagataaagctagaaagtctgaacattttatttcaaaatcatacgaatcggggtcagttaagcctcagtattcttagcttttgttgattttggcactatctttatattattaaatatatttgttgtttggatatttcatataaagatggctataattacatatttcattcccaatttgtgtgtgttggggggtacttttaaaggtgactattgttttgtacatctaattttgggaaagcaagtctataagacatcttgtgatttcttaatgtttttgtttgtatgtttttcaaagatatcactgtcctttatcatgttttgaagattgtttaaaattcattttcctaaattaatgtgcaagtaatgttttgaggatatcagtgttttatattaaacatatttccaattcattaaattgaggtgtaatttttttccttaagaaacatgagctactgttagaaataaatttccagttgtatgctg

SEQ ID NO: 30336 - DNA, 5717 bp, Homo sapiens
gtgcgcagattgagaatggagctttccggtcgggcgggaggaggtgacgtcaggagtggtggcgggcgggggcctctggtagccctggggacgctgtatctgtgggctcttgaatcgcgtcacaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagacgatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaagtatatgctgaaatgatttctaaccctctccctacttaaacctcccagacttgttctggttcataaaagcaagaggtaaaactggaaaaattgtgcacgtgttacctatgaatctacacgcctgccatttgcagtgctccggctgctggtcccagaggtatactggttacagctattgcagccagttccctgagacttgtaaaactcctggtttaggacatggggcctgtggtgtggatggaaaatgctgggcctactggatggtcagccagaggccatgtggtgggtgatgactgaagcgggagcaggttgtaccacacctctcccccccccctcccactccccctccctccctctcccctccccctccctccctcccccctccctccctcccccccctccccctccctccccctccctctctccctaacacccaccctccccctttcccccaccctccccccttctcccctttccccaccctccctccccccttccccctcccccccccccccccgcagcccctgctcctttctctgggctcctggcattgtgccagtgagtgctgggaccaggtaatgagcacagccaaaaaggccagaggttcactaggtcagcatcataccaaacgcctggctttcaccaggcatcagtgtgcttcacttgagagtttggtaccatggttaagatcgagtccatgctaggtaagtcctgttaggaatgtcagtttgtattccgcccacgtgaatgatgctgagcttaatgtattattttgaggggcttcttcagagcagttctcactgagctttccattaacctacactcttccggacggctcttaaaacttgcaggacataatgaaattgggaagagcagagtgttgaagtctatagcatggccttctgcttgaccctgagttcctgaattgaatgtgggagaccacaggccatacttctctaggcactcacatgtctcccttggcataaggaaacatgttagtaatatagttttttagatccaaacagtttatttggatctaaaagtttaagtgttcagttgaaaaacagctattgattttattagtagcaaattatcaccattaaagccagtggttttttttttgttttttttttttgttttttttttttttttttgcgacagagtctcttgtcgcccaggctggagtacaatggtgtgatctcagctcactgcaacctccgcctcccaggttcaagcgattctcctgcctcagcctcctgcgtagctgggattacaggtgcccaccaccacaccctgctaatttttgtacttttagtagagatggggtttcgccatgttggccaggctggtcttgaactgctgacctcaggtgatccacccgcctcggcctcccaaagtgctggtattacagtcatgagccacctcacccagcctgtttttgagacggagtttcacttttgtcgcccaggctggagtgcaatggcgctatctcagctcactgcaacccccacctcccaggttcaagcgattctcctgcctcagcctcccgagtagctgggattacaggcatgtgccaccacccctggctaattttgtatttttagtggagacggggtttctccatgttggtcaggctggtcttaaactcccgacctcaagtgatctgcccgcctcggcctcccaaagtgctgggattacaggcgtgagccattgcacctgtccctgccagtgtgtttttaaaatagtttagggggttgagaaaagatgcagtgagccattattctcctttagcaggtagtctcttaaaaattgatgtggattttaaaaatataccattgagaacacgtatctttctcaaacttgaccttgaacagagctggatgggggtgggagggaaacagatttggggcatatggaagatattcttgggagccccatattctacctcagttaccgaaggctattagaacctctgaatttttcctcctctgaaatcctaagcacaacttcagaaaaccatgtctgatagcggatgtcttcctgctgtgaggagctgcttgatgtggggaccaaggtgtgggtgtgggcggaatgtatcctagtagaaacagtgaacctcagatatgaataaataagcaagagaccgaaagttaagtgtgtgacaacctcagtactgtagttaagctacattctttaaattagcttttgtgaactgattgggaacctaatctcttttgtaactgtttgagaaaaactctgaagcacctgatattcaaacaaacttatggtacttactaactcatttgtaaattggcgatgtagctggctgtagtattgctttgataatttttttcttttaatttacctaatatatataaggaaggggtttggatatattaaaataggtgttaattttatctatttaccaataaattcatctctttaattca

SEQ ID NO: 30337 - DNA, 2383 bp, Homo sapiens
acaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagacgatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtt

SEQ ID NO: 30338 - DNA, 2805 bp, Homo sapiens
gggcctctggtagccctggggacgctgtatctgtgggctcttgaatcgcgtcacaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtcaatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagacgatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacct

SEQ ID NO: 30339 - DNA, 2108 bp, Homo sapiens
aaggataatcccactccttggccagtggatggacagtcacccatgtctctactgtggaccacaggacagcgaaggcaccaactggcagacaagtcccagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagacgatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgt

SEQ ID NO: 30340 - DNA, 2429 bp, Homo sapiens
cccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgcggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatatatatatatatatatatatatatatatat

SEQ ID NO: 30341 - DNA, 2222 bp, Homo sapiens
ccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatatatatatatatatatatatatatatatataaaaatatataaatgccacggtcctgctctggtcaataaaggatcctttgttgatacgtaa

SEQ ID NO: 30342 - DNA, 3894 bp, Homo sapiens
ggcggggctgtaccggaagttgcctctacttccgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcagtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtatgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttatgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaagcac

SEQ ID NO: 30343 - DNA, 3890 bp, Homo sapiens
ggcggggctgtaccggaagttgcctctacttccgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcagtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaa

SEQ ID NO: 30344 - DNA, 3890 bp, Homo sapiens; identical to SEQ ID NO: 30343

SEQ ID NO: 30345 - DNA, 3890 bp, Homo sapiens; identical to SEQ ID NO: 30343

SEQ ID NO: 30346 - DNA, 3890 bp, Homo sapiens
ggcggggctgtaccggaagttgcctctacttccgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcagtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgctctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaa

SEQ ID NO: 30347 - DNA, 3535 bp, Homo sapiens
ttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagcctcccagtccttatggggaaatccaactcagtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtatgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttatgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagc

SEQ ID NO: 30348 - DNA, 3890 bp, Homo sapiens
ggcggggctgtaccggaagttgcctctacttccgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcagtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtatgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttatgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaa

SEQ ID NO: 30349 - DNA, 3378 bp, Homo sapiens
aggcagctgctgtggctccaggatgatggagacagagcgacttgtgctaccccctccagatcccctggacctaccccttcgggccgtggagctcggatgcacggggcactgggagctgctgaacttgcctggagctccagagagtagcatcttcttactattccacctggtttcaagaaaggcatggactttgcaccaaaagattgtccaactccagctcctggactactaagccttagctgtatgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttatgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagc

SEQ ID NO: 30350 - DNA, 3378 bp, Homo sapiens; identical to SEQ ID NO: 30349

SEQ ID NO: 30351 - DNA, 1157 bp, Homo sapiens
acttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcagtatcccttctggccaggggggatggatgaacccaccataacagatctgaacacacgggaggaggctgaggaggagatagactttgagaaagatcttcttactattccacctggtttcaagaaaggcatggactttgcaccaaaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgaggtaagggccatgggct

SEQ ID NO: 30352 - DNA, 3535 bp, Homo sapiens
ttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagcctcccagtccttatggggaaatccaactcagtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgctctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagc

SEQ ID NO: 30353 - DNA, 3378 bp, Homo sapiens
aggcagctgctgtggctccaggatgatggagacagagcgacttgtgctaccccctccagatcccctggacctaccccttcgggccgtggagctcggatgcacggggcactgggagctgctgaacttgcctggagctccagagagtagcatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagc

SEQ ID NO: 30354 - DNA, 2694 bp, Homo sapiens
agctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagc

SEQ ID NO: 30355 - DNA, 3535 bp, Homo sapiens
ttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagcctcccagtccttatggggaaatccaactcagtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagc

SEQ ID NO: 30356 - DNA, 2694 bp, Homo sapiens; identical to SEQ ID NO: 30354

SEQ ID NO: 30357 - DNA, 2694 bp, Homo sapiens
agctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttatgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagc

SEQ ID NO: 30358 - DNA, 1157 bp, Homo sapiens
acttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcagtatcccttctggccaggggggatggatgaacccaccataacagatctgaacacacgggaggaggctgaggaggagatagactttgagaaagatcttcttactattccacctggtttcaagaaaggcatggactttgcaccaaaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgctctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgaggtaagggccatgggct

SEQ ID NO: 30359 - DNA, 2694 bp, Homo sapiens; identical to SEQ ID NO: 30354

SEQ ID NO: 30360 - DNA, 3535 bp, Homo sapiens; identical to SEQ ID NO: 30355

SEQ ID NO: 30361 - DNA, 3535 bp, Homo sapiens; identical to SEQ ID NO: 30355

SEQ ID NO: 30362 - DNA, 1157 bp, Homo sapiens; identical to SEQ ID NO: 30351

SEQ ID NO: 30363 - DNA, 3535 bp, Homo sapiens; identical to SEQ ID NO: 30347

SEQ ID NO: 30364 - DNA, 1157 bp, Homo sapiens; identical to SEQ ID NO: 30351

SEQ ID NO: 30365 - DNA, 2694 bp, Homo sapiens; identical to SEQ ID NO: 30354

SEQ ID NO: 30366 - DNA, 1157 bp, Homo sapiens; identical to SEQ ID NO: 30351

SEQ ID NO: 30367 - DNA, 3378 bp, Homo sapiens; identical to SEQ ID NO: 30353

SEQ ID NO: 30368 - DNA, 3378 bp, Homo sapiens; identical to SEQ ID NO: 30353

SEQ ID NO: 30369 - DNA, 3378 bp, Homo sapiens
aggcagctgctgtggctccaggatgatggagacagagcgacttgtgctaccccctccagatcccctggacctaccccttcgggccgtggagctcggatgcacggggcactgggagctgctgaacttgcctggagctccagagagtagcatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgctctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagc

SEQ ID NO: 30370 - DNA, 966 bp, Homo sapiens
gtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 30371 - DNA, 625 bp, Homo sapiens
ctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatctt

SEQ ID NO: 30372 - DNA, 3595 bp, Homo sapiens
atgccccgagctgggaccgaccctccggctccacgcccttttttttttttttttttaggtcccgggcgttgagctctactcagtgcacgcagccacacaatatgctcttggacgtcgccccctggaggggatgttatctcccgcctccttgaagtcgcccatttctggggttgccccatccagggagctggttcctagttaagaatatgagaatgtatgcgcagggaggcaggcaacagcacgaacagccacgcttctagaagattctagggagcgcgcaggagcagcgcagagggagtaggaatgagcaggcggaggacccgaggtcacgagaccgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaatgtgtcctgtgcttttagatttttaaattccataatatacattcttaattttcaactcaa

SEQ ID NO: 30373 - DNA, 944 bp, Homo sapiens
cagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgc

SEQ ID NO: 30374 - DNA, 549 bp, Homo sapiens
aacagtgtcctcctgacttgtgctggagtgattgtgcctatgtagagaattccactttaagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaag

SEQ ID NO: 30375 - DNA, 3123 bp, Homo sapiens
cgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctg

SEQ ID NO: 30376 - DNA, 3539 bp, Homo sapiens
ggccggaggggtggtgaacgccgtcgtggtgatggtgagggccttagcgaccaccacccgagtgaggccccctcaccttcaggcccagagccgaggggaggagcctcccccagggccggcgggggcgggcaggtgagccgggcaggtgcgcaggcgagcgcggcgggctgggcgggccgaggccacaccctgaaactacctgcgtgggccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaacggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgcatatctgcctcccctgtctctaaggagcagcgggaacggagcttcggggcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttctttttaggtaagtttctttt

SEQ ID NO: 30377 - DNA, 4507 bp, Homo sapiens
gagagagagagagagagagagagagagagagagacagtgagaaagaaagaaaaagagagcgcccttgtgcacgcgctaggccaagagcgcgccgctgtgcgcgcgcccgcctagcgaggacagggtctccatgacaaccggcctggccggctagcagtgctctgctcacttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcgcccacagcctgggcatccgggagaagatatcagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtggaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgacaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccaga

SEQ ID NO: 30378 - DNA, 4315 bp, Homo sapiens
cacagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcgcccacagcctgggcatccgggagaagatatcagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtggaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgacaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggccc

SEQ ID NO: 30379 - DNA, 1411 bp, Homo sapiens
attatgacttcaaggaagaatggaggtggggcgcatagctggcaagaaaccccgtgggaacaaagaagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagcttttgagtactttgtggtggtgtccctcaagaagaagccatcgcgaaacacctacctccccgaagtctcctaccagtttcccaaggaatgtgctttctccagctcttcacgtggctgctggctccttctcatttctcaggctctgctcaagtaggacctctttcaggaggtctgtccagacacctgcatggagcccctcccctgcccagcttgctctgctggaccgacccaccaagcagatgcgagaggcagaggaaaggctcaaagccattccccagttttgcttccctgatgccaaggactggcttcctgtgtcagagtatatgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcg

SEQ ID NO: 30380 - DNA, 590 bp, Homo sapiens
agacccagacaactcttggtcggatggtgaggagcccggccgcagcccggggcgcggatgcctgcccgccgcccgccctctctgcaggagcggctcctcctccgggccgcgcggctcccggcgagaccccatccaggcgccgcgcccggcccggctggggaacgcagagggatggtgacagaatggatagtatagaaaatggattggaattgaggaggaaactagaagctaagaggagttaggaggcccttgtaacaatccagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtacc

SEQ ID NO: 30381 - DNA, 580 bp, Homo sapiens
tccagacccagacaactcttggtcggatggtgaggagcccggccgcagcccggggcgcggatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccacca

SEQ ID NO: 30382 - DNA, 600 bp, Homo sapiens
agcccggggcgcggatgcctgcccgccgcccgccctctctgcaggagcggctcctcctccgggccgcgcggctcccggcgagaccccatccaggcgccgcgcccggcccggctggggaacgcagaggaagatgagagactgcttaggcgccaccactagtaccatgagtccctgcactggttaaagccatcgccacaacctggacaggcagcaagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccat

SEQ ID NO: 30383 - DNA, 559 bp, Homo sapiens
tcccggcgagaccccatccaggcgccgcgcccggcccggctggggaacgcagagatttcacaccctttggagagtttctttcttggataattcagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgg

SEQ ID NO: 30384 - DNA, 887 bp, Homo sapiens
cttggtcggatggtgaggaggtgagggccgtccagtttgggggccaacttctcctccctgctgcccccggcccccgcctccctcacccctgtcccccaccctccctcgcacactctcggcgcggctttctcgctgcctccggcgcctccgagcgctcccctccgccgggctccagcagcccaccctctctgtcttgggtggaggcgcacatcctccacgccccctccactcaaatctgcgctccctcccctctctctccctgcagcccggccgcagcccggggcgcggatgcctgcccgccgcccgccctctctgcaggagcggctcctcctccgggccgcgcggctcccggcgagaccccatccaggcgccgcgcccggcccggctggggaacgcagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatg

SEQ ID NO: 30385 - DNA, 523 bp, Homo sapiens
gccgcgcccggcccggctggggaacgcagagatttcacaccctttggagagtttctttcttggataattcagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccgggg

SEQ ID NO: 30386 - DNA, 3019 bp, Homo sapiens
tttcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagag

SEQ ID NO: 30387 - DNA, 550 bp, Homo sapiens
gttgacactctgaatggtttgtgaaggcatcctctggcccctgaaggcattaccatccttaccaggtttaaaatctttcagagtgcacccagcatcatcagctcctgcaagcagaaagggcccaagggagcatgaacacacactggggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacct

SEQ ID NO: 30388 - DNA, 573 bp, Homo sapiens
gtgcgcgcccggtcccgcccctgccctcccagcccttttccctctgctcccgactcccggccccggcagcggtgtccagctccatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagaga

SEQ ID NO: 30389 - DNA, 576 bp, Homo sapiens
agacccagacaactcttggtcggatggtgaggagcccggccgcagcccggggcgcggatgcctgcccgccgcccgccctctctgcaggagcggctcctcctccgggccgcgcggctcccggcgagaccccatccaggcgccgcgcccggcccggctggggaacgcagagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcag

SEQ ID NO: 30390 - DNA, 514 bp, Homo sapiens
aaacttagggggtctgccgtgtcccagggactgtgctcattttctgacaggagcaatattattaccgactgtgacagcagctcccactaagcctgcaccttagctgcagatccttagcagggcagagagacaaggctgtatttgtatcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccct

SEQ ID NO: 30391 - DNA, 631 bp, Homo sapiens
agaccccgttgtgctttgctccagacccagacaactcttggtcggatggtgaggagcccggccgcagcccggggcgcggatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaag

SEQ ID NO: 30392 - DNA, 560 bp, Homo sapiens
agtgctctgctcacttggctgcgaggagcgccacgaaaggtcagaggaaggagctgtgggaagctcgcagcagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgt

SEQ ID NO: 30393 - DNA, 940 bp, Homo sapiens
acttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaa

SEQ ID NO: 30394 - DNA, 2679 bp, Homo sapiens
gaagaaaacaagtccactcactgtcttctcccttctcccctctgagctgttcaagcaagttcccaggagcagttcagagcccctgttggactggaagggaggtaggaggagtggaatgcatgcaaaaaccgagctgatcaaaagacagtgctgtttcatggaagcctcccagaactgagagagagagagagagagagagagagagagagacagtgagaaagaaagaaaaagagagcgcccttgtgcacgcgctaggccaagagcgcgccgctgtgcgcgcgcccgcctagcgaggacagggtctccatgacaaccggcctggccggctagcagtgctctgctcacttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaa

SEQ ID NO: 30395 - DNA, 588 bp, Homo sapiens
ttgactttcacttccccaggcctcagtgcctcttcccacagaggctgggttttctccttgttgctgcctgagcaggtgaccttgggatggttcccacagagcagtgtggctccaggcactgccctttgctgtctacttcagcacctgtggcttcagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgg

SEQ ID NO: 30396 - DNA, 534 bp, Homo sapiens
gatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcagggtcttgctgtgttgctcgggctgctcttgaactcctgggctcaaacagtcctcttgcctcagcctcccaacgtgctgggattacgggagcaagccaccccactgtgtgcagcccagaagttgagcctgagagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagct

SEQ ID NO: 30397 - DNA, 751 bp, Homo sapiens
acataatatccagtgcgtcctccctggcactccgattctcagtagtcatgaaccagctggcttctatatctctcaccaatcacagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccatt

SEQ ID NO: 30398 - DNA, 3396 bp, Homo sapiens
ttctgcctgcttcctgaggagtggggtctgagttcctctggggcgtaaggcacattcagacatctgtagaacaagtgtgggactcagtggcacccaggctcaatcctgctgctgagcagaggtgctggagtgagtcctgctctgcagcaggaaaatagggaaaggggtgcagagagggctgtgttctgagttccccagggacctgttcaccccacggattctgccaccaggattgagctaggactgacccggcccatggtgttactctattttagaaaatgtgtgtgttggaggggtgggggcaggagatacagcttgtggaaaggagtgccactcaacatcttcaagggcagggattctgttttggacttttctgagattttctggtaatgccaatacaatgcccgctgccagagattttagaactagtcctgagaagcaagaactcccctcacccccaccctttggcccagactccttccaagcctttcacacctcccctgtgtcacagcaggagagtttgttccaaaaggggagtgttgatggttctctttttgctgagatcagcggtagagggaatagacactacagtaggagagtcatcgaacagatcattactgaacacttcctccttgctaatcactgttccgttccgaggttgcctcagtgaacaacacaaaaccctgccctaaaagacttgttgaacggcatcgtaggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccag

SEQ ID NO: 30399 - DNA, 502 bp, Homo sapiens
gggccatgagggctccaccctcatgaatggattaatgctgtcattgctagagtttgtttctgataaaaacaagtccggccccctcctgccctctctctcttttgtgtgtactgttgtgcccttctgcctttctgctatgggatgatgcaggaagaaggcccgcaccagattcagccatcaatcttaagacttccaagcctctggaaccgtaagaaataaatcctcacttcattagcataaattcagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaag

SEQ ID NO: 30400 - DNA, 299 bp, Homo sapiens
acataatatccagtgcgtcctccctggcactccgattctcagtagtcatgaaccagctggcttctatatctctcaccaatcacaggtaatttaggtctccctcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcag

SEQ ID NO: 30401 - DNA, 1309 bp, Homo sapiens
gtagcctccccactgcagacgggcagctgcatgactcatgagctgaggggccaggcagaagccattctctttggttcacaggaattctgcttgtttatttgtgtgtgtgtgagttcgtgtgtttccttcttcccttctcccccttctctaactcttcctcctctgcaggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtgga

SEQ ID NO: 30402 - DNA, 583 bp, Homo sapiens
gtcacataatatccagtgcgtcctccctggcactccgattctcagtagtcatgaaccagctggcttctatatctctcaccaatcacaggtaatttaggtctccctcagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgccc

SEQ ID NO: 30403 - DNA, 556 bp, Homo sapiens
gtgtgtatgagaaaatgacataaagtttcagaccccgttgtgctttgctccagacccagacaactcttggtcggatggtgaggagcccggccgcagcccggggcgcggatgcctgcccgccgcccgccctctctgcaggagcggctcctcctccgggccgcgcggctcccggcgagaccccatccaggcgccgcgcccggcccggctggggaacgcagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagct

SEQ ID NO: 30404 - DNA, 638 bp, Homo sapiens
gattactgtgctttgggattaaagtgtcctgccgtttctggaagagactgctagtcataaagacaggtagggctgaagggtggaggtagggtctccagctgcagttgtcaagaacccaacgtgaaggctgactgagcagagaaactgctgctgcccagaaagaaagcacttttagcagtgggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcag

SEQ ID NO: 30405 - DNA, 4545 bp, Homo sapiens
gggggtcgggggtcgggggctgggggctgaggactgagtcgagccagcagcccagggcatctgtccacgctgtcagaggagcctctgggcgtggggctggcccttagagggctactgcgctgcttaacttgcctttcacagaaaaccactggaggagatactcacaaaaatgaaggggaagaacaggaaacaggaagacatgagatgaaggaaacaggagattcaacatggatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcgcccacagcctgggcatccgggagaagatatcagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtggaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgacaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagag

SEQ ID NO: 30406 - DNA, 564 bp, Homo sapiens
taatatccagtgcgtcctccctggcactccgattctcagtagtcatgaaccagctggcttctatatctctcaccaatcacaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagccca

SEQ ID NO: 30407 - DNA, 659 bp, Homo sapiens
agacccagacaactcttggtcggatggtgaggaggtgagggccgtccagtttgggggccaacttctcctccctgctgcccccggcccccgcctccctcacccctgtcccccaccctccctcgcacactctcggcgcggctttctcgctgcctccggcgcctccgagcgctcccctccgccgggctccagcagcccaccctctctgtcttgggtggaggcgcacatcctccacgccccctccactcaaatctgcgctccctcccctctctctccctgcagcccggccgcagcccggggcgcggatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtca

SEQ ID NO: 30408 - DNA, 2899 bp, Homo sapiens
gggacctttagagagttagcaataaggctggagaaggaaaagccggcgcgcccgcggcccgcgcgatttcccgccgagcccgcgtccccggcggcgggcgggctccgggggcgcccgggccgcggcggcggcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgaaattaggtccagagttgaagttcccctaattgcttcctctaccatctgggagataaaattgttaccaaagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctatgattgacattttctgctcggcagagttcagggactggaattgcaagagtattttcatgcgtgttgaagatgaactggaaatccctccggcacctcaatctcaacatttccaaaactgaactcatcacccctcttcccccaccaccaaaactgctcctcctcctgtattcctgacctccgccatccaccccgttgctcaagccggaaactcggcagcccttccaaactcttccctctctcactccccacatcccatcgtctcggccttcacaatctgtcagttctaacctcctaagcaactaggccttcagtaaatgtgattcacctcttctttccctccttttcccaaagcatccctcttagtctaggtccttgttgtttcttgcctgaactcctgccatagtcttaactggtctccttgcttcctgtcttatcctccaccgtctttcttttatactgacacaagaatggtctttctgaattgcacatgtgagcatgtcacttccctgcttaaatttctccagtggattcccagggacttcaggatcaagtcctagttgttcagcatggcatccaagactctttatgatctggcccttgcttacctctcagccttagctctcccaactcttgcacagtcactgctcttcagccatagtggatcactcaccattcccagatgtaccaggctctcgcacacctctgcacctttgcacgtgctgtttgctgtgcgtggaatgcccttcactgtcaccaccctgctcatccactctactaatgcctcttcattcttttatactcagctttctttaaagttcttctaagctgagttaggtgtctgtcctttatgatcccgcagtattccatgaatacgtatattctcacatttattgtactgtattataattgttgaaaacttgtctgtcccatttagaatgtgagctccttgagagcagaacggtgtcttcattatctctgtatccccaaggctttgcacagtgccttgctcatagtaggttttcaataaatgattattaaataaataa

SEQ ID NO: 30409 - DNA, 2360 bp, Homo sapiens
gtcttactgctacagcagggctggggattgcagtatccgctgttgctgctgctcccagtcctgcccctgctgctacctagtccagcctcaccgcatcccagaagaggcacgtcggccttcatttgcctagtggattttcaaaagcagctcttcggtttttggtgctgttaagagaccttgcatttcaatcacaccgggagaaaactgaagctcgtaacaggagaatctggcagctggacacagcttggactgcattgtctggcttcatgacccctgctgtgtagccggctcatctcttcactctcacatgtacactctcctcgcttttctttcttttttttttcccttttctttcttctaatttttaaaaagcagcctctggagccagccatgtttggcactgaatcttcatagaaaaatatttgttgaatgagtgaacgtgggatctctgttcattttggtatattactttgctttctgggctgagctcaggacagatgccaaagcctttccctctaatgacatcaaagccctacttctaaaaccagactggatgtgattcccttctacaaacagattcagtaaagaaatgtgaatactcccacaaaaagcccatgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattcttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaa

SEQ ID NO: 30410 - DNA, 2113 bp, Homo sapiens
cctgcccctgctgctacctagtccagcctcaccgcatcccagaagaggcacgtcggccttcatttgcctagtggattttcaaaagcagctcttcggtttttggtgctgttaagagaccttgcatttcaatcacaccgggagaaaactgaagctcgtaacaggagaatctggcagctggacacagcttggactgcattgtctggcttcatgacccctgctgtgtagccggctcatctcttcactctcacatgtacactctcctcgcttttctttcttttttttttcccttttctttcttctaatttttaaaaagcagcctctggagccagccatgtttggcactgaatcttcattgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaa

SEQ ID NO: 30411 - DNA, 2182 bp, Homo sapiens
cctgcccctgctgctacctagtccagcctcaccgcatcccagaagaggcacgtcggccttcatttgcctagtggattttcaaaagcagctcttcggtttttggtgctgttaagagaccttgcatttcaatcacaccgggagaaaactgaagctcgtaacaggagaatctggcagctggacacagcttggactgcattgtctggcttcatgacccctgctgtgtagccggctcatctcttcactctcacatgtacactctcctcgcttttctttcttttttttttcccttttctttcttctaatttttaaaaagcagcctctggagccagccatgtttggcactgaatcttcattgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgaaattaggtccagagttgaagttcccctaattgcttcctctaccatctgggagataaaattgttaccaaagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaa

SEQ ID NO: 30412 - DNA, 2110 bp, Homo sapiens
ttagcaataaggctggagaaggaaaagccggcgcgcccgcggcccgcgcgatttcccgccgagcccgcgtccccggcggcgggcgggctccgggggcgcccgggccgcggcggcggcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaa

SEQ ID NO: 30413 - DNA, 577 bp, Homo sapiens
acaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagagaaaaatatttgttgaatgagtgaacgtgggatctctgttcattttggtatattactttgctttctgggctgagctcaggacagatgccaaagcctttccctctaatgacatcaaagccctacttctaaaaccagactggatgtgattcccttctacaaacagattcagtaaagaaatgtgaatactcccacaaaaagcccatgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactct

SEQ ID NO: 30414 - DNA, 542 bp, Homo sapiens
cgtttcattttctggctgatagagttgtacttggaaaatactcagtttcctgcttactgcttcattatggattatacagagaaaaatatttgttgaatgagtgaacgtgggatctctgttcattttggtatattactttgctttctgggctgagctcaggacagatgccaaagcctttccctctaatgacatcaaagccctacttctaaaaccagactggatgtgattcccttctacaaacagattcagtaaagaaatgtgaatactcccacaaaaagcccatgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcga

SEQ ID NO: 30415 - DNA, 6667 bp, Homo sapiens
tctggaaaagaaggcgagatcttctagagcctctaatcttggcatccttcgtgccctcaccttgtcgcttctgtagagataaagaaggaatgacttaatttctgttccggttggttctcttggtacctgaagatacatccagaaagtgcccagaagaaacttcctgctggaaaaaatgaaaaagcagtatttataacattagaatctggataatttgttaacatggcagaaaataatgaaaatattagtaaaaatgtagatgtaaggcccaaaactagtcggagcagaagtgccgacagaaaagacggttatgtgtggagtggaaagaagttatcttggtcaaaaaagagtgagagttattcagatgctgagacagtgaatggtatagagaaaaccgaagtgtctttaaggaaccaagaaaggaagcacagctgttcatccattgagttggacttagatcattcctgtgggcatcgatttttaggccgatctcttaaacagaaactgcaagatgccgtggggcagtgttttccaataaagaattgtagtagtcggcactcttcagggcttccgtctaaaaggaaaattcatatcagtgaactcatgttagataagtgtcctttcccacctcgatcagatttagcctttaggtggcattttattaaacgacacactgctcctataaattccaaatcagatgaatgggtaagcacagacttgtctcagactgaattgagggatggtcagctaaaacgaagaaatatggaagaaaatataaactgtttctcacataccaatgttcagccctgtgtcataaccaccgacaatgctttgtgtagagaaggtcctatgactggctctgtgatgaacctggtttcaaataacagtatagaagatagtgatatggattccgatgatgaaattctaacactttgcacaagttccagaaaaagaaacaaacccaaatgggatttggatgatgaaatcctgcagttggaaacacctcctaaataccacacgcagattgattatgtccactgtcttgtaccagacctccttcagatcaataacaacccatgttactggggagtgatggataaatacgcagccgaagcactactggaaggaaaaccagagggtacctttttacttcgagactcagcacaggaagactatttattctctgttagttttagacgctatagtcgttctcttcatgctagaattgaacagtggaatcacaactttagctttgatgcacatgacccctgtgtcttccattctcctgacattactgggctcctagaacattataaggacccaagcgcctgtatgttctttgaaccacttctatccactcccttaattcggactttccctttttccctgcagcatatatgcagaacagttatttgtaactgtacaacttatgatggcatcgatgcccttccaattccttcttctatgaaattatatctgaaggaatatcattataaatcaaaagttagagtactcaggattgatgcaccagaacagcaatgctagtaacaggatgggaacatgggaatgataatatatattttttcttttaatattttatttttctttttatgccactttggatttttctacaaaggcagtggtgtccaaaataaaatctctgccctaaattttactaataaatccatttttctagtgatacacaaattgtttaaggttatacactcgagcttaaatagatatttttaaccaggtgtttggtttttgtttttaccgtgtaggttgtatacttacattttttctttccttaatttatacatgatcctttttccttaatttatacatgatccaggcacatttgaaatttggtaggcattgcaaacacatttgaatattgtgtatttcatactattctttaaaagtaatcttatgtcctttcctacatgtaaaatattttgttaatctatgccattagtagtattatatataaaatatagttccccgtcccccttttcattgagtttgatattcttcagtaaagctgaatgttgtaattcaccattcatactaatgttattgacttttgtaacttactaatagggatgttaaaagtaacaaaaccaagtcaaacttggtgtatttttattttaaatattaactctaaagcaggattactaaatttgattaatctggtcaatgagaatcaaatggaaacatatcattctggaggtgcacttactcttctacaatgtggccggatcatttgtcattcctgaataggtctttctctcaacctgcaagagctaaaccatcttcaaaacataaatcttgttcctttctcattggaagctttgaaaataatgataacactattagtagctagtagttactaaagtgctaaagtaattgtggggtttttctgtattagcttatgaactgttgcttctacttagcccttttatagaaactctgagctgttactttggggaaattccacaatgtattagcagccacaaatttccactggtaaccaaagagtacctaagtagtttttcattattttaagttgaatttgaataaagattccagaaataaacatggagctcagtattcaggaagcttaatactgtttttgatctacaagatccaaataattatccctatcttcagaattaacttagtctgtaatgtggcttcaaaaaaagaaagccttttgacagctacatgacttacaccatacagaacagtactggacaaaaggggtgatattttaaatttactatcccagaaacagggcaacgtttttagaaacatctttagcccaaagtaactagtaaaaataaatggagtggtatcctatcttctttttttaaggaatcaatgaataataaatgtagatagacaattttcttctggtgagctgtctaaccctttgtacacattgacatttttaatatcgtaactgatttcttgatgctagtttagctatattaggaaactgcttctacctagattgaaagaaatttgactcataaacttccaagttagaacaaatatttcttcattattgttgcttttatgtgagtagcatttccctatcttgcagttctgttaacatgaaaatggcatttttccataatagctttaaaataattttttagtaattattacaaaattaaggaaaatctctattaccgttatcttttagcattttttttttcctcagtgatctcaagattgtcttagtctcaatgagatgtagctacaaaaatggcacctcttagcagtgatgaggctcaggatatcggatatcataacaccaatgtcaggataaatatctcttctaaagacgatatttaccttttacaaggttagaaaagtctcatactacctcatctttattgtggcgcttttgtagatcactgagaagcttatcttattaaccaatataccacttcctaaatatccatctttggtgaaagaaaatagtgtggtaagagtacccatgattatagttttttatcagaatttgataagattttctgtttctgtgaaacaattattttaaatatttttcttttaaaaataactttttatcagtacagaaaaacctaagggatgactagcttacaaatattctgttaaggggtagttttataaagaaaaatgatatatagttatgttgtcttttatagtgttaaaattagtatttatatgaaagtcaagatctaagtaccttttcatataattcaaactgattgcttgtgatatgttttctctggcttttttattttttcaacttcaaggtattaacagctgttaacacttaaaaagtactgccacatatgtagccttgaagtagttgatctaataaatgagagcagggaggagattcattgactctgaaatgatttttatttttcctttggtatttgctacagtgaaaagaagtttggaaagtagatacataaagacttgagaagggaattgtttaagggaaaagaaaagagtaataattttttttaaaacattaaggaattggaattcagaaaggttacccccttcctctgtgtctttgtaaggatacatttggaagaacatacagtattcagaaactaacctatataaaatgtaaacaatatattgattgcactatataaatgagtaaattttgagaggaacaatgtgggaatgtataaatttgtctaaaattttataactgttgaacaaagggaagatttgaacagtgtaaattccagagttgagaaagcatttagcatggtggaaatgtggagagcttattggtgagagaggatggagctaagagaaataagatcaaatattaaaattaggaatttaggcattacctcagggaaaagccttgacagtgaaaagaaactacttaatcgctaatagctagtctggaccagacacttaactgcgctttgggaatcatcctgggctaatcaggaaataaacttgacttttctatttttctctgaagctttacaggacatactcccactcccatttttttctaagcctacagcatcttgattcatagtataattcctgaagtatgctgaatggactttttaaggttcctttagcatttttgtatagagttatatgtgatctttctataaccatgccattcacttaaataattcatgaagggaatggtttaatttaaaggaagacctaataggaagaagattaaaggaagcttttagtcagcctgtggctagatttattgatttggtgatcaaacctgtgctatttcctgaatttcagctaatggccaactgtggtcaaagaatggctttcagttaaagttttgacttcttattataaataatataaagaatgtctcagtaattagaaatcccttaataagtagaacaaatgtggcaagtaggactcctatcggtatacaaattccatttctttttataagaaaaacacataaaccattatcatttattcatgagccaaagccattaagaagataaatccagttatcagcttcctgtctctgaagtttggatcattttatagatccacgcaatagagagcttccttcctatgaaacaaaaaccttgagatctctttttttttgagacagagtctcgctgttgtcagcccaggctggagtgcaatggcgcaatctcggttcactgcaacctctgccttccaggttccagcaattctcctacctcagctcccaagtagctgagatgacaggcgtgtgccaccacgcccagctaatttttgtatttttagtagcgatggtgtttcactacattggccaggctggtctcgaactcctgacctcaggtgaccacccgcctcagcctcccaaagtgctgggattacaggcatgagccactgtgcccggccaagatctaactcacgcttacttttcattaaaatatttcttgtcgcttttagctattgtcagaatccaataaacagcttacgcattcattttggtaaagcaaatttcacaggaaaatagacaaaattataagagattcctggagacaacacaaggaaaacaatgtttaaaagcaaaatagcctgtgtaatgttaggtaatgtaatgcccaagtgaataaaagatttttcgtcaagcaaactactgtttctactttgggggaaaaaagtcagttttacatttgtaatttaaggaaagaacagaaagcacaaaggtttttcttttctttattaatggcctactagaaatgagcagtgcaagagtctacctgtactattctaatacagtaagatattggacacaaaatggaggtaactttttaaaatagattggcttggaagttgaaatgtagattaatggatataacccaatagaaagggattttcaaataaaaccaaagtctatttttttatttactttctaattttgaacagatgactcagtcctaaatctttgcctttatttcctataaaatgtaggtgatacttgtaactcgacttcctggagttaattcttcagcaagaggtgaccctgggagcgtactttaaaataattgctgtacagccattgagtactaacatgatgataggttttcaaaatatctttgtagtggatgctgcataattacattcacttctcttagactgtaaaagactttcttgacttgttttaacagtagagatagcagtacaatttgaatttatggtttaggctctgcaattagaggaacaattgcagtttcctcctacccttcatatggtctgtgtaaaactgatgtttgcttaacttattttaaaagttgattacgttttcagaaaataaagataatcacttttgccatggttataatcaaatctaagctttcagacttgagagccatggtgtaaaactcaaggaggtttatttaaattatgctgactttgctagaattggataaattctgtataagccaagtatgagttcacatgtactcgaatatacagttttcacaaagctattactctcatcagtcaggcttgtatgatctattccttaccacaaaagaagtagacaattgccacttttatttctaatccttaagttgaatgtttcttcttggatgtaagttcaaataaattgatctggataaattttcatttctacttaattaaaacttcctatgtaaaatcc

SEQ ID NO: 30416 - DNA, 6779 bp, Homo sapiens
ctgaacacggaagtggtggcggcgcccagggaaccggcggaggcgatgaccgtgacggctgggttgggaccggaacgccgaagcggggttgggggtggcagaaaagcatctgctttgtaagacctacacgaggtgcaggagtggttgggcctcccctctccacttaagcaagcgcccagactgatggcgatggtgatggcagcagttactcgcacaaccccagttaagctgcgctccgggagatacatccagaaagtgcccagaagaaacttcctgctggaaaaaatgaaaaagcagtatttataacattagaatctggataatttgttaacatggcagaaaataatgaaaatattagtaaaaatgtagatgtaaggcccaaaactagtcggagcagaagtgccgacagaaaagacggttatgtgtggagtggaaagaagttatcttggtcaaaaaagagtgagagttattcagatgctgagacagtgaatggtatagagaaaaccgaagtgtctttaaggaaccaagaaaggaagcacagctgttcatccattgagttggacttagatcattcctgtgggcatcgatttttaggccgatctcttaaacagaaactgcaagatgccgtggggcagtgttttccaataaagaattgtagtagtcggcactcttcagggcttccgtctaaaaggaaaattcatatcagtgaactcatgttagataagtgtcctttcccacctcgatcagatttagcctttaggtggcattttattaaacgacacactgctcctataaattccaaatcagatgaatgggtaagcacagacttgtctcagactgaattgagggatggtcagctaaaacgaagaaatatggaagaaaatataaactgtttctcacataccaatgttcagccctgtgtcataaccaccgacaatgctttgtgtagagaaggtcctatgactggctctgtgatgaacctggtttcaaataacagtatagaagatagtgatatggattccgatgatgaaattctaacactttgcacaagttccagaaaaagaaacaaacccaaatgggatttggatgatgaaatcctgcagttggaaacacctcctaaataccacacgcagattgattatgtccactgtcttgtaccagacctccttcagatcaataacaacccatgttactggggagtgatggataaatacgcagccgaagcactactggaaggaaaaccagagggtacctttttacttcgagactcagcacaggaagactatttattctctgttagttttagacgctatagtcgttctcttcatgctagaattgaacagtggaatcacaactttagctttgatgcacatgacccctgtgtcttccattctcctgacattactgggctcctagaacattataaggacccaagcgcctgtatgttctttgaaccacttctatccactcccttaattcggactttccctttttccctgcagcatatatgcagaacagttatttgtaactgtacaacttatgatggcatcgatgcccttccaattccttcttctatgaaattatatctgaaggaatatcattataaatcaaaagttagagtactcaggattgatgcaccagaacagcaatgctagtaacaggatgggaacatgggaatgataatatatattttttcttttaatattttatttttctttttatgccactttggatttttctacaaaggcagtggtgtccaaaataaaatctctgccctaaattttactaataaatccatttttctagtgatacacaaattgtttaaggttatacactcgagcttaaatagatatttttaaccaggtgtttggtttttgtttttaccgtgtaggttgtatacttacattttttctttccttaatttatacatgatcctttttccttaatttatacatgatccaggcacatttgaaatttggtaggcattgcaaacacatttgaatattgtgtatttcatactattctttaaaagtaatcttatgtcctttcctacatgtaaaatattttgttaatctatgccattagtagtattatatataaaatatagttccccgtcccccttttcattgagtttgatattcttcagtaaagctgaatgttgtaattcaccattcatactaatgttattgacttttgtaacttactaatagggatgttaaaagtaacaaaaccaagtcaaacttggtgtatttttattttaaatattaactctaaagcaggattactaaatttgattaatctggtcaatgagaatcaaatggaaacatatcattctggaggtgcacttactcttctacaatgtggccggatcatttgtcattcctgaataggtctttctctcaacctgcaagagctaaaccatcttcaaaacataaatcttgttcctttctcattggaagctttgaaaataatgataacactattagtagctagtagttactaaagtgctaaagtaattgtggggtttttctgtattagcttatgaactgttgcttctacttagcccttttatagaaactctgagctgttactttggggaaattccacaatgtattagcagccacaaatttccactggtaaccaaagagtacctaagtagtttttcattattttaagttgaatttgaataaagattccagaaataaacatggagctcagtattcaggaagcttaatactgtttttgatctacaagatccaaataattatccctatcttcagaattaacttagtctgtaatgtggcttcaaaaaaagaaagccttttgacagctacatgacttacaccatacagaacagtactggacaaaaggggtgatattttaaatttactatcccagaaacagggcaacgtttttagaaacatctttagcccaaagtaactagtaaaaataaatggagtggtatcctatcttctttttttaaggaatcaatgaataataaatgtagatagacaattttcttctggtgagctgtctaaccctttgtacacattgacatttttaatatcgtaactgatttcttgatgctagtttagctatattaggaaactgcttctacctagattgaaagaaatttgactcataaacttccaagttagaacaaatatttcttcattattgttgcttttatgtgagtagcatttccctatcttgcagttctgttaacatgaaaatggcatttttccataatagctttaaaataattttttagtaattattacaaaattaaggaaaatctctattaccgttatcttttagcattttttttttcctcagtgatctcaagattgtcttagtctcaatgagatgtagctacaaaaatggcacctcttagcagtgatgaggctcaggatatcggatatcataacaccaatgtcaggataaatatctcttctaaagacgatatttaccttttacaaggttagaaaagtctcatactacctcatctttattgtggcgcttttgtagatcactgagaagcttatcttattaaccaatataccacttcctaaatatccatctttggtgaaagaaaatagtgtggtaagagtacccatgattatagttttttatcagaatttgataagattttctgtttctgtgaaacaattattttaaatatttttcttttaaaaataactttttatcagtacagaaaaacctaagggatgactagcttacaaatattctgttaaggggtagttttataaagaaaaatgatatatagttatgttgtcttttatagtgttaaaattagtatttatatgaaagtcaagatctaagtaccttttcatataattcaaactgattgcttgtgatatgttttctctggcttttttattttttcaacttcaaggtattaacagctgttaacacttaaaaagtactgccacatatgtagccttgaagtagttgatctaataaatgagagcagggaggagattcattgactctgaaatgatttttatttttcctttggtatttgctacagtgaaaagaagtttggaaagtagatacataaagacttgagaagggaattgtttaagggaaaagaaaagagtaataattttttttaaaacattaaggaattggaattcagaaaggttacccccttcctctgtgtctttgtaaggatacatttggaagaacatacagtattcagaaactaacctatataaaatgtaaacaatatattgattgcactatataaatgagtaaattttgagaggaacaatgtgggaatgtataaatttgtctaaaattttataactgttgaacaaagggaagatttgaacagtgtaaattccagagttgagaaagcatttagcatggtggaaatgtggagagcttattggtgagagaggatggagctaagagaaataagatcaaatattaaaattaggaatttaggcattacctcagggaaaagccttgacagtgaaaagaaactacttaatcgctaatagctagtctggaccagacacttaactgcgctttgggaatcatcctgggctaatcaggaaataaacttgacttttctatttttctctgaagctttacaggacatactcccactcccatttttttctaagcctacagcatcttgattcatagtataattcctgaagtatgctgaatggactttttaaggttcctttagcatttttgtatagagttatatgtgatctttctataaccatgccattcacttaaataattcatgaagggaatggtttaatttaaaggaagacctaataggaagaagattaaaggaagcttttagtcagcctgtggctagatttattgatttggtgatcaaacctgtgctatttcctgaatttcagctaatggccaactgtggtcaaagaatggctttcagttaaagttttgacttcttattataaataatataaagaatgtctcagtaattagaaatcccttaataagtagaacaaatgtggcaagtaggactcctatcggtatacaaattccatttctttttataagaaaaacacataaaccattatcatttattcatgagccaaagccattaagaagataaatccagttatcagcttcctgtctctgaagtttggatcattttatagatccacgcaatagagagcttccttcctatgaaacaaaaaccttgagatctctttttttttgagacagagtctcgctgttgtcagcccaggctggagtgcaatggcgcaatctcggttcactgcaacctctgccttccaggttccagcaattctcctacctcagctcccaagtagctgagatgacaggcgtgtgccaccacgcccagctaatttttgtatttttagtagcgatggtgtttcactacattggccaggctggtctcgaactcctgacctcaggtgaccacccgcctcagcctcccaaagtgctgggattacaggcatgagccactgtgcccggccaagatctaactcacgcttacttttcattaaaatatttcttgtcgcttttagctattgtcagaatccaataaacagcttacgcattcattttggtaaagcaaatttcacaggaaaatagacaaaattataagagattcctggagacaacacaaggaaaacaatgtttaaaagcaaaatagcctgtgtaatgttaggtaatgtaatgcccaagtgaataaaagatttttcgtcaagcaaactactgtttctactttgggggaaaaaagtcagttttacatttgtaatttaaggaaagaacagaaagcacaaaggtttttcttttctttattaatggcctactagaaatgagcagtgcaagagtctacctgtactattctaatacagtaagatattggacacaaaatggaggtaactttttaaaatagattggcttggaagttgaaatgtagattaatggatataacccaatagaaagggattttcaaataaaaccaaagtctatttttttatttactttctaattttgaacagatgactcagtcctaaatctttgcctttatttcctataaaatgtaggtgatacttgtaactcgacttcctggagttaattcttcagcaagaggtgaccctgggagcgtactttaaaataattgctgtacagccattgagtactaacatgatgataggttttcaaaatatctttgtagtggatgctgcataattacattcacttctcttagactgtaaaagactttcttgacttgttttaacagtagagatagcagtacaatttgaatttatggtttaggctctgcaattagaggaacaattgcagtttcctcctacccttcatatggtctgtgtaaaactgatgtttgcttaacttattttaaaagttgattacgttttcagaaaataaagataatcacttttgccatggttataatcaaatctaagctttcagacttgagagccatggtgtaaaactcaaggaggtttatttaaattatgctgactttgctagaattggataaattctgtataagccaagtatgagttcacatgtactcgaatatacagttttcacaaagctattactctcatcagtcaggcttgtatgatctattccttaccacaaaagaagtagacaattgccacttttatttctaatccttaagttgaatgtttcttcttggatgtaagttcaaataaattgatctggataaattttcatttctacttaattaaaacttcctatgtaaaatccaa

SEQ ID NO: 30417 - DNA, 4110 bp, Homo sapiens
gcggcgcccagggaaccggcggaggcgatgaccgtgacggctgggttgggaccggaacgccgaagcggggttgggggtggcagaaaagcatctgctttgtaagacctacacgaggtgcaggagtggttgggcctcccctctccacttaagcaagcgcccagactgatggcgatggtgatggcagcagttactcgcacaaccccagttaagctgcgctccgggaggagttcatctgttgtctgctctccagtgacttccgtttgtggagcctaagtgtttctacagaatccaactcaaatatcaaggactatgatcagaatgctttcaaggagtttttgggcacatgatggcagatacatccagaaagtgcccagaagaaacttcctgctggaaaaaatgaaaaagcagtatttataacattagaatctggataatttgttaacatggcagaaaataatgaaaatattagtaaaaatgtagatgtaaggcccaaaactagtcggagcagaagtgccgacagaaaagacggttatgtgtggagtggaaagaagttatcttggtcaaaaaagagtgagagttattcagatgctgagacagtgaatggtatagagaaaaccgaagtgtctttaaggaaccaagaaaggaagcacagctgttcatccattgagttggacttagatcattcctgtgggcatcgatttttaggccgatctcttaaacagaaactgcaagatgccgtggggcagtgttttccaataaagaattgtagtagtcggcactcttcagggcttccgtctaaaaggaaaattcatatcagtgaactcatgttagataagtgtcctttcccacctcgatcagatttagcctttaggtggcattttattaaacgacacactgctcctataaattccaaatcagatgaatgggtaagcacagacttgtctcagactgaattgagggatggtcagctaaaacgaagaaatatggaagaaaatataaactgtttctcacataccaatgttcagccctgtgtcataaccaccgacaatgctttgtgtagagaaggtcctatgactggctctgtgatgaacctggtttcaaataacagtatagaagatagtgatatggattccgatgatgaaattctaacactttgcacaagttccagaaaaagaaacaaacccaaatgggatttggatgatgaaatcctgcagttggaaacacctcctaaataccacacgcagattgattatgtccactgtcttgtaccagacctccttcagatcaataacaacccatgttactggggagtgatggataaatacgcagccgaagcactactggaaggaaaaccagagggtacctttttacttcgagactcagcacaggaagactatttattctctgttagttttagacgctatagtcgttctcttcatgctagaattgaacagtggaatcacaactttagctttgatgcacatgacccctgtgtcttccattctcctgacattactgggctcctagaacattataaggacccaagcgcctgtatgttctttgaaccacttctatccactcccttaattcggactttccctttttccctgcagcatatatgcagaacagttatttgtaactgtacaacttatgatggcatcgatgcccttccaattccttcttctatgaaattatatctgaaggaatatcattataaatcaaaagttagagtactcaggattgatgcaccagaacagcaatgctagtaacaggatgggaacatgggaatgataatatatattttttcttttaatattttatttttctttttatgccactttggatttttctacaaaggcagtggtgtccaaaataaaatctctgccctaaattttactaataaatccatttttctagtgatacacaaattgtttaaggttatacactcgagcttaaatagatatttttaaccaggtgtttggtttttgtttttaccgtgtaggttgtatacttacattttttctttccttaatttatacatgatcctttttccttaatttatacatgatccaggcacatttgaaatttggtaggcattgcaaacacatttgaatattgtgtatttcatactattctttaaaagtaatcttatgtcctttcctacatgtaaaatattttgttaatctatgccattagtagtattatatataaaatatagttccccgtcccccttttcattgagtttgatattcttcagtaaagctgaatgttgtaattcaccattcatactaatgttattgacttttgtaacttactaatagggatgttaaaagtaacaaaaccaagtcaaacttggtgtatttttattttaaatattaactctaaagcaggattactaaatttgattaatctggtcaatgagaatcaaatggaaacatatcattctggaggtgcacttactcttctacaatgtggccggatcatttgtcattcctgaataggtctttctctcaacctgcaagagctaaaccatcttcaaaacataaatcttgttcctttctcattggaagctttgaaaataatgataacactattagtagctagtagttactaaagtgctaaagtaattgtggggtttttctgtattagcttatgaactgttgcttctacttagcccttttatagaaactctgagctgttactttggggaaattccacaatgtattagcagccacaaatttccactggtaaccaaagagtacctaagtagtttttcattattttaagttgaatttgaataaagattccagaaataaacatggagctcagtattcaggaagcttaatactgtttttgatctacaagatccaaataattatccctatcttcagaattaacttagtctgtaatgtggcttcaaaaaaagaaagccttttgacagctacatgacttacaccatacagaacagtactggacaaaaggggtgatattttaaatttactatcccagaaacagggcaacgtttttagaaacatctttagcccaaagtaactagtaaaaataaatggagtggtatcctatcttctttttttaaggaatcaatgaataataaatgtagatagacaattttcttctggtgagctgtctaaccctttgtacacattgacatttttaatatcgtaactgatttcttgatgctagtttagctatattaggaaactgcttctacctagattgaaagaaatttgactcataaacttccaagttagaacaaatatttcttcattattgttgcttttatgtgagtagcatttccctatcttgcagttctgttaacatgaaaatggcatttttccataatagctttaaaataattttttagtaattattacaaaattaaggaaaatctctattaccgttatcttttagcattttttttttcctcagtgatctcaagattgtcttagtctcaatgagatgtagctacaaaaatggcacctcttagcagtgatgaggctcaggatatcggatatcataacaccaatgtcaggataaatatctcttctaaagacgatatttaccttttacaaggttagaaaagtctcatactacctcatctttattgtggcgcttttgtagatcactgagaagcttatcttattaaccaatataccacttcctaaatatccatctttggtgaaagaaaatagtgtggtaagagtacccatgattatagttttttatcagaatttgataagattttctgtttctgtgaaacaattattttaaatatttttcttttaaaaataactttttatcagtacagaaaaacctaagggatgactagcttacaaatattctgttaaggggtagttttataaagaaaaatgatatatagttatgttgtcttttatagtgttaaaattagtatttatatgaaagtcaagatctaagtaccttttcatataattcaaactgattgcttgtgatatgttttctctggcttttttattttttcaacttcaaggtattaacagctgttaacacttaaaaagtactgccacatatgtagccttgaagtagttgatctaataaatgagagcagggagg

SEQ ID NO: 30418 - DNA, 4771 bp, Homo sapiens
ggcagccgcgcagagcgcgcacccaagcggccggacctccccgactcccgggccgcccccgtctcgcgccctgcctccctccttcggccttcacctacccgcctccggattggccgctaggaatcccgcccctctaaagccctgcctgctattggtcacgattttataatcaatggataaagtgggaaaaatgtggaataacttcaaatacaggtgtcagaatctcttcggtcatgagggaggaagccgtagtgaaaatgtggacatgaactccaacagatgtttgtctgtcaaagagaaaaacatcagcataggagactcaactcctcagcaacaaagcagtcccttaagagaaaatattgccttacaactgggattaagcccttcgaagaattcttcaaggagaaatcaaaattgtgccacagaaatccctcaaattgttgaaataagcatcgaaaaggataatgattcttgtgttaccccaggaacaagacttgcacgaagagattcctactctcgacatgctccatggggtgggaagaaaaaacattcctgttctacaaagacccagagttcattggatgctgataaaaagtttggtagaactcgaagtggacttcaaaggagagagaggcgctacggcgtaagttctgtacacgacatggacagtgtttccagcagaactgtaggaagtcgctctctaagacagaggttgcaggatactgtgggcttgtgttttcccatgagaacttacagcaagcagtcaaagcctctcttttccaataaaagaaaaatccatctctctgaattaatgcttgagaaatgcccttttcctgctggctcagatttagcccaaaaatggcatttgattaaacagcatacagctcctgtgagcccacattcaacattttttgatacatttgatccatctttggtttctacagaagatgaagaagataggcttagagagagaaggcggcttagtattgaagaaggggttgatccccctcccaatgcacaaatacatacatttgaagctactgcacaggttaatccattatataaactgggaccaaaattagctcctggaatgactgaaataagtggggacagttctgcaattccacaagctaattgtgactcggaagaggatacaaccaccctgtgtttgcagtcacggaggcagaagcagcgtcagatatctggagacagccatacccatgttagcagacagggagcttggaaagtccacacacagattgattacatacactgcctcgtgcctgatttgcttcaaattacagggaatccctgttactggggagtgatggaccgttatgaagcagaagcccttctcgaagggaaacctgaaggcacgtttttgctcagggactctgcgcaagaggactacctcttctctgtgagcttccgccgctacaacagatccctgcatgcccgaattgagcagtggaatcacaactttagtttcgacgcccatgacccgtgtgtatttcactcctccactgtaacgggacttttagaacattataaagatcccagttcgtgcatgttttttgaaccattgcttactatatcactaaataggactttcccttttagcctgcagtatatctgtcgcgcggtaatctgcaggtgcactacgtatgatggaattgatgggctccctctaccctcaatgttacaggattttttaaaagagtatcattataaacaaaaagttagagttcgctggttggaacgagaaccagtcaaggcaaagtaaactctccggtccccaaaggttgttaactaggtccgctttcatgtgcatcagacagtacacctatagcaagcacacgtagcagtgttaggctttttcatacagtatgtaagcttagtgttagtatctgtcagatgctacctgctgttacttattcagataaacatggtgcctattggaacaatagcggatagagctacaggtgttcagtaagactacaaaaacattttgcctatttcgctaacagtttggtttttaatggctgtggtatttgagtgaggcaactctggggcatttgttatgaagaattctatttcttactgaagaacaaattattaatattggatgagtatttcaacagtgtgactaatgtttgaaattattttttctaagagtttttctataaccttccaaaagtcgtgatgtttgtagttactataaatcaagctttggaagtccaaaaagaataaaagactgccttccttttagaaaaaaatgcaattttctggccacaagggcatagtgcagttcacttacgtgttgatgtagtttataatcagacgccttttctcttctgcaaaaggtactgttaagtaaaccagattttctaaataggcattcttaaaatttcagacttacaaagctagtagtagaattttattgaaaggcctaggtattaattttttaaatgagtgctttaacttaaaacaggcgtttggaatagctgctgcaatgtagtcttgtgtgtgatttttttttaagttgatgtgcagtctaattgttgtttcataaaagttggatctgttcctatgcccaggatgattttgtgaaccgtgaagtacgtgagactagaagacgcccaaacaagtcagataatagtaactacaatggttgctgatgttgagattattgttgaactataattaataatttggatggcagaatttatctcttttttgtaaactctcataactgaattgcttaagtataatttatagaatttcagtgcagttcattcttaatggaaaatctgaaacctaaattgcagatttaaaaggtactgtacaaccattatatctgtaaataacttagcacctttttgtcacttagaataatatgtactactacttgagtgagcgcttttggaagttatatcaagttctagtgtttgcttcttagtaactgaactgaatttacagttctgtcctagacattttgcactaaagtagccgaatccactctcatgtcttttcgttaatgtgctctgtaccactggtgagtgctccatagtttccttacctgctgctacagaatgttattttacatccctatggctattgccaaggctacaaaaaaggaaagctatatttgtatgcaacactaaccttttgactgctaatgtatgtttctgcttgctgtgccttgttatggctgctttttttgtgctaataaagtatgtttggtgttctccttgtatatctgctgttttatacatttgcaacaatttctcttgtaaatggaatggtttggggtttttaaataagcattaactaacaacctttctatagttaatgcagagttaatgaacagtctaatattgacttatcagaataagctaactctaaatttaatgctctacatcttatcagtcataattatatatactgtggaacagtatctgtagttactgcaaattactgtacagtttaggttataacagaaaactgacagagaagtaataaacctattgatttctctgcttataaatgaaagattgaaactatccaatgacatattatagtaaatgagtatctgtaacctcccactgcatcagaagcaggttaaatgaagtcttgtgaatttgtaatagatcagtaccatttattggtttggggaccatcttaattaaaaataaatgcccaaaatgtagaactttaaccaaagacttgtcccttttaaagcaaaatggggattgaagggacttataatttctgttgtttctaattaaagtccctgaagatcatataccaaagtgtttgagaacttcatccaaacctactttaaagcattatgtgcaattaagttgttatgacataattatattgcctaattgttgggtcttttttcttgagcttataatgtacctggaaaataaacctcttgagaaaaagaaaagttcatactgattattggaaaaggactatatatgtgagcaagattgtgttttagagaggaaacttgaaactccaagaaagcacttgatgtttttatatgcttgtagcaaattgatgttctaactgtagttttatagaaagtattaatgcttttatgtatttcaaaactttcatatgttaaatggaaattgttttaaatgtgtttgagtttatgtaagcatgtatacactgtgctaaaagtcacatgtttcagtttgtgtataatattaatatgcaatttttggtttaaatttttgtcttaaaatattagtggcttacattttaaaaaagaaaaatcaccagcatgaacttgcacctaagtctatattcactgtgtccttttctgaatcccattgtagcctgtcaactaaatttgagtgttaacggtctttttaaagtgcatttaaatacaaaccaggaatttctttagaagttgagatacatctttatagttgaaataattaacccaagaaaaggttgctttgatttgtacccattctcattcattttcttcattcccttacacacacacacacacctctcccttccgcatacatataagtgtgtattatatatttatgtatgcacatatatacatttatgttgttaatattactttagatggcatttccacctgatacaaaaacatttagagatcttattctatagatattacctaaagagtattcttgtactattcgaattttattatctgcactaaaagtttagccttgctactttagccttgtttataatacagtcaccttacaaagagaaa

SEQ ID NO: 30419 - DNA, 4058 bp, Homo sapiens
gggggttggggggaggggggaggggaaacgggtgaagaaggggaggcggcagggaagggggtgggggcctggcgggggcatccggcggagctggggtccccgggctccgtccggaggaagcgacgctgcgctcgctgggcagtcggaggggacgggacgcaccggagggcaggcggactcgccctgtcggtgactgcgccgtccgggcccgtcctgcctggccgcaggtgccctggatgaggccgccccgcgcgccccaaacgattttataatcaatggataaagtgggaaaaatgtggaataacttcaaatacaggtgtcagaatctcttcggtcatgagggaggaagccgtagtgaaaatgtggacatgaactccaacagatgtttgtctgtcaaagagaaaaacatcagcataggagactcaactcctcagcaacaaagcagtcccttaagagaaaatattgccttacaactgggattaagcccttcgaagaattcttcaaggagaaatcaaaattgtgccacagaaatccctcaaattgttgaaataagcatcgaaaaggataatgattcttgtgttaccccaggaacaagacttgcacgaagagattcctactctcgacatgctccatggggtgggaagaaaaaacattcctgttctacaaagacccagagttcattggatgctgataaaaagtttggtagaactcgaagtggacttcaaaggagagagaggcgctacggcgtaagttctgtacacgacatggacagtgtttccagcagaactgtaggaagtcgctctctaagacagaggttgcaggatactgtgggcttgtgttttcccatgagaacttacagcaagcagtcaaagcctctcttttccaataaaagaaaaatccatctctctgaattaatgcttgagaaatgcccttttcctgctggctcagatttagcccaaaaatggcatttgattaaacagcatacagctcctgtgagcccacattcaacattttttgatacatttgatccatctttggtttctacagaagatgaagaagataggcttagagagagaaggcggcttagtattgaagaaggggttgatccccctcccaatgcacaaatacatacatttgaagctactgcacaggttaatccattatataaactgggaccaaaattagctcctggaatgactgaaataagtggggacagttctgcaattccacaagctaattgtgactcggaagaggatacaaccaccctgtgtttgcagtcacggaggcagaagcagcgtcagatatctggagacagccatacccatgttagcagacagggagcttggaaagtccacacacagattgattacatacactgcctcgtgcctgatttgcttcaaattacagggaatccctgttactggggagtgatggaccgttatgaagcagaagcccttctcgaagggaaacctgaaggcacgtttttgctcagggactctgcgcaagaggactacctcttctctgtgagcttccgccgctacaacagatccctgcatgcccgaattgagcagtggaatcacaactttagtttcgacgcccatgacccgtgtgtatttcactcctccactgtaacgggacttttagaacattataaagatcccagttcgtgcatgttttttgaaccattgcttactatatcactaaataggactttcccttttagcctgcagtatatctgtcgcgcggtaatctgcaggtgcactacgtatgatggaattgatgggctccctctaccctcaatgttacaggattttttaaaagagtatcattataaacaaaaagttagagttcgctggttggaacgagaaccagtcaaggcaaagtaaactctccggtccccaaaggttgttaactaggtccgctttcatgtgcatcagacagtacacctatagcaagcacacgtagcagtgttaggctttttcatacagtatgtaagcttagtgttagtatctgtcagatgctacctgctgttacttattcagataaacatggtgcctattggaacaatagcggatagagctacaggtgttcagtaagactacaaaaacattttgcctatttcgctaacagtttggtttttaatggctgtggtatttgagtgaggcaactctggggcatttgttatgaagaattctatttcttactgaagaacaaattattaatattggatgagtatttcaacagtgtgactaatgtttgaaattattttttctaagagtttttctataaccttccaaaagtcgtgatgtttgtagttactataaatcaagctttggaagtccaaaaagaataaaagactgccttccttttagaaaaaaatgcaattttctggccacaagggcatagtgcagttcacttacgtgttgatgtagtttataatcagacgccttttctcttctgcaaaaggtactgttaagtaaaccagattttctaaataggcattcttaaaatttcagacttacaaagctagtagtagaattttattgaaaggcctaggtattaattttttaaatgagtgctttaacttaaaacaggcgtttggaatagctgctgcaatgtagtcttgtgtgtgatttttttttaagttgatgtgcagtctaattgttgtttcataaaagttggatctgttcctatgcccaggatgattttgtgaaccgtgaagtacgtgagactagaagacgcccaaacaagtcagataatagtaactacaatggttgctgatgttgagattattgttgaactataattaataatttggatggcagaatttatctcttttttgtaaactctcataactgaattgcttaagtataatttatagaatttcagtgcagttcattcttaatggaaaatctgaaacctaaattgcagatttaaaaggtactgtacaaccattatatctgtaaataacttagcacctttttgtcacttagaataatatgtactactacttgagtgagcgcttttggaagttatatcaagttctagtgtttgcttcttagtaactgaactgaatttacagttctgtcctagacattttgcactaaagtagccgaatccactctcatgtcttttcgttaatgtgctctgtaccactggtgagtgctccatagtttccttacctgctgctacagaatgttattttacatccctatggctattgccaaggctacaaaaaaggaaagctatatttgtatgcaacactaaccttttgactgctaatgtatgtttctgcttgctgtgccttgttatggctgctttttttgtgctaataaagtatgtttggtgttctccttgtatatctgctgttttatacatttgcaacaatttctcttgtaaatggaatggtttggggtttttaaataagcattaactaacaacctttctatagttaatgcagagttaatgaacagtctaatattgacttatcagaataagctaactctaaatttaatgctctacatcttatcagtcataattatatatactgtggaacagtatctgtagttactgcaaattactgtacagtttaggttataacagaaaactgacagagaagtaataaacctattgatttctctgcttataaatgaaagattgaaactatccaatgacatattatagtaaatgagtatctgtaacctcccactgcatcagaagcaggttaaatgaagtcttgtgaatttgtaatagatcagtaccatttattggtttggggaccatcttaattaaaaataaatgcccaaaatgtagaactttaaccaaagacttgtcccttttaaagcaaaatggggattgaagggacttataatttctgttgtttctaattaaagtccctgaagatcatataccaaagtgtttgagaacttcatccaaacctactttaaagcattatgtgcaattaagttgttatgacataattatattgcctaattgttgggtcttttttcttgagcttataatgtacctggaaaataaacctcttgagaaaaagaaaa

SEQ ID NO: 30420 - DNA, 3774 bp, Homo sapiens
gtgcagaggtggcagttccgggcgccggggaggtgtagagaacagattcggaaactggggaggtctagcatgtggcgtaggagggggtcctcactccgcttcgcgattgccaaaacgagcctgccggaagcgccctaaggggttttcttctcccagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtct

SEQ ID NO: 30421 - DNA, 3553 bp, Homo sapiens
agtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcct

SEQ ID NO: 30422 - DNA, 3698 bp, Homo sapiens
aacgggtaggttctcgcgagaggacccgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtct

SEQ ID NO: 30423 - DNA, 3710 bp, Homo sapiens
aacgggtaggttctcgcgagaggacccgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtct

SEQ ID NO: 30424 - DNA, 3742 bp, Homo sapiens
agagaacagattcggaaactggggaggtctagcatgtggcgtaggagggggtcctcactccgcttcgcgattgccaaaacgagcctgccggaagcgccctaaggggttttcttctcccagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaa

SEQ ID NO: 30425 - DNA, 3902 bp, Homo sapiens
aagccttttcttccctctaggccagaggaccccacctggagccctagtagccaaggggaagagttaagaaggaggaaagtaagatgtcggccccgcactccgcccaggccagccctgcctctctcaagatggcgacctggaagtgcgtcgcccgtgccagccccggaaatctcgtgttaggcgaggtcaacgggtaggttctcgcgagaggacccgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaa

SEQ ID NO: 30426 - DNA, 5876 bp, Homo sapiens
cgactccattttcctcggtgggggcttagcgcactggaggagcggcgggcttcagacagttatcttcaggcagagtgagaagctgcagcaatgtctgattttgtggaaagcgaggctgaggagtcagaggaagaatacaatgatgaaggcgaggtggtaccccgagtcaccaagaaatttgtggaagaggaggatgatgatgaggaggaggaggaggagaacctagatgatcaggatgagcaaggcaacttgaaaggctttatcaatgacgatgatgatgaagatgaaggggaggaggatgagggcagtgactctggtgattcagaagatgatgttggccacaagaagagaaaacgcacctcttttgatgaccgcctggaggatgatgattttgacctcattgaggagaatttgggtgtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggcctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattg

SEQ ID NO: 30427 - DNA, 2876 bp, Homo sapiens
cgactccattttcctcggtgggggcttagcgcactggaggagcggcgggcttcagacagttatcttcaggcagagtgagaagctgcagcaatgtctgattttgtggaaagcgaggctgaggagtcagaggaagaatacaatgatgaaggcgaggtggtaccccgagtcaccaagaaatttgtggaagaggaggatgatgatgaggaggaggaggaggagaacctagatgatcaggatgagcaaggcaacttgaaaggctttatcaatgacgatgatgatgaagatgaaggggaggaggatgagggcagtgactctggtgattcagaagatgatgttggccacaagaagagaaaacgcacctcttttgatgaccgcctggaggatgatgattttgacctcattgaggagaatttgggtgtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggcctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagctaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattg

SEQ ID NO: 30428 - DNA, 2484 bp, Homo sapiens
gcgtcactgtccgccgccgtgtccgcggctgcgccagacagtgtagaacctgcggcctcgatgtccttctcccgtgccctattgtgggctcggctcccggcggggcgccaggctggccaccgggcagccatctgctctgcccttcgtccccactttgggccctttcccggggttctggggcaagtttctgtccttgccaccgcctcctcctctgcctccggtggctccaaaataccaaacacgtccttgttcgtgcccctgactgtgaaacctcagggccccagcgccgacggcgacgtcggggccgagctaacccggcctctggacaagaatgaagtaaagaaggtcttagacaaattttacaagaggaaagaaattcagaaactgggtgctgattatggacttgatgctcgtctcttccaccaagctttcataagctttagaaattatattatgcagtctcattccctggatgtggacattcacattgttttgaatgatatttgcttcggtgcagctcatgcggatgatttattcccatttttcttgagacatgccaaacaaatatttcctgtgttggactgtaaggatgatctacgtaaaatcagtgacttaagaataccacctaactggtacccagatgctagagccatgcagcggaagataatatttcattcaggccccacaaacagtggaaagacttatcacgcaatccagaaatacttctcagcaaagtctggagtgtattgtggccctctaaaattactggcacatgagatcttcgaaaagagtaatgctgctggtgtgccatgtgacttggtgacaggtgaagagcgtgtgacagttcagccaaatgggaaacaggcttcacatgtttcttgtacagttgagatgtgcagtgttacaactccttatgaagtggctgtaattgatgaaattcaaatgattagagatccagccagaggatgggcctggaccagagcacttctaggactgtgtgctgaagaggttcatttgtgtggagaacctgctgctattgacctggtgatggagcttatgtacacaacgggggaggaagtggaggttcgagactataagaggcttacccccatttctgtgctggaccatgcactagaatctttagataaccttcggcctggggactgcattgtctgttttagcaagaatgatatttattctgtgagtcggcagattgaaattcggggattagaatcagctgttatatatggcagtctcccacctgggaccaaacttgctcaagcaaaaaagtttaatgatcccaatgacccatgcaaaatcttggttgctacagatgcaattggcatgggacttaatttgagcataaggagaattattttttactcccttataaagcccagtatcaatgaaaagggagagagagaactagaaccaatcacaacctctcaagccctgcagattgctggcagagctggcagattcagctcacggtttaaagaaggagaggttacaacaatgaatcatgaagatctcagtttattaaaggaaattttgaagaggcctgtggatcctataagggcagctggtcttcatccaactgctgagcagattgaaatgtttgcctaccatctccctgatgcaacactgtccaatctcattgatatttttgtagacttttcacaagttgatgggcagtattttgtctgcaatatggatgattttaaattttctgcagagttgatccagcatattccactaagtctgcgagtgaggtatgttttctgcacagctcctatcaacaagaagcagccttttgtgtgttcttcactgttacagtttgccaggcagtatagcaggaatgagcccctgacctttgcatggttacgccgatacatcaaatggcctttacttccacctaagaatattaaagacctcatggatcttgaagctgtccacgatgtcttggatctttacttgtggctaagctaccgatttatggatatgtttccagatgccagccttattcgagatctccagaaagaactagatggtattatccaagatggtgtgcacaatatcactaaattgattaaaatgtctgagacgcataagctgttgaatttggagggctttccatcagggagccagtcacgattgtcaggaaccttaaagagccaagctagaaggacacgcggcaccaaagctctagggagtaaagctactgagccacccagccccgatgcaggagagctgtcccttgcttccagattggtgcagcaaggactcctcactccagacatgctgaaacagctagaaaaagagtggatgacacaacaaactgaacacaacaaagaaaaaacagagtctgggactcatccaaaagggacgagaagaaagaagaaggaacctgattcggactagttttctgttcctgtttttttttttttatttaattttgcaaataaaaatttattttgaatcctt

SEQ ID NO: 30429 - DNA, 794 bp, Homo sapiens
ctcgatgtccttctcccgtgccctattgtgggctcggctcccggcggggcgccaggctggccaccgggcagccatctgctctgcccttcgtccccactttgggccctttcccggggttctggggcaagtttctgtccttgccaccgcctcctcctctgcctccggtggctccaaaataccaaacacgtccttgttcgtgcccctgactgtgaaacctcagggccccagcgccgacggcgacgtcggggccgagctaacccggcctctggacaagaatgaagtggctgtaattgatgaaattcaaatgattagagatccagccagaggatgggcctggaccagagcacttctaggactgtgtgctgaagaggttcatttgtgtggagaacctgctgctattgacctggtgatggagcttatgtacacaacgggggaggaagtggaggttcgagactataagaggcttacccccatttctgtgctggaccatgcactagaatctttagataaccttcggcctggggactgcattgtctgttttagcaagaatgatatttattctgtgagtcggcagattgaaattcggggattagaatcagctgttatatatggcagtctcccacctgggaccaaacttgctcaagcaaaaaagtttaatgatcccaatgacccatgcaaaatcttggttgctacagatgcaattggcatgggacttaatttgagcataaggagaattattttttactcccttataaagcccagtatcaatgaaaagggagagagagaactagaac

SEQ ID NO: 30430 - DNA, 1233 bp, Homo sapiens
atggcggcggtcggggccgaggcgcgaggagcttggtgtgtgccttgcctagtttcacttgatactcttcaggaattatgtagaaaagaaaagctcacatgtaaatcgattggaatcaccaaaaggaatctaaacaattatgaggtggaatacttgtgtgactacaaggtagtaaaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactga

SEQ ID NO: 30431 - DNA, 1292 bp, Homo sapiens
gccagtttgaatgaaagctctacaagatggcggcggtcggggccgaggcgcgaggagcttggtgtgtgccttgcctagtttcacttgatactcttcaggaattatgtagaaaagaaaagctcacatgtaaatcgattggaatcaccaaaaggaatctaaacaattatgaggtggaatacttgtgtgactacaaggtagtaaaggatatggaatattatcttgtaaaatggaaaggatggccagattctacaaatacttgggaacctttgcaaaatctgaagtgcccgttactgcttcagcaattctctaatgacaagcataattatttatctcaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaa

SEQ ID NO: 30432 - DNA, 719 bp, Homo sapiens
atcccgtcagaccgcgccagtttgaatgaaagctctacaagatggcggcggtcggggccgaggcgcgaggaggtgaggctggagcgcggccccctcgccttccctgttcccagcttggtgtgtgccttgcctagtttcacttgatactcttcaggaattatgtagaaaagaaaagctcacatgtaaatcgattggaatcaccaaaaggaatctaaacaattatgaggtggaatacttgtgtgactacaaggtagtaaaggatatggaatattatcttgtaaaatggaaaggatggccagattctacaaatacttgggaacctttgcaaaatctgaagtgcccgttactgcttcagcaattctctaatgacaagcataattatttatctcaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaaga

SEQ ID NO: 30433 - DNA, 3087 bp, Homo sapiens
cggggccgaggcgcgaggaggtgaggctggagcgcggccccctcgccttccctgttcccaggcaagctcccaaggcccgggcggcggggccgtcccgcgggccagccagatggcgacgtggcggttccccgcccgccgcgaccccaactccgggacgcacgctgcggacgcctatcctcccccaggccgctgacccgcctccctgcccggccggctcccgccgcggaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctccaaaaaaaaaaaa

SEQ ID NO: 30434 - DNA, 5837 bp, Homo sapiens
gggcgcggggggcgcgacggcggcggcggcggccggttgggggcggggggctcggacgctgcggggactcatttttcccgtcagcggagggagcgagcggtgctgcggcccgcgccgccatcttggattttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagatcatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttcttaaaaaaaaaaaaaaaatgacatacgtgacagctcacttttcagttcattatatgtacgagggtagcagtgtgtgggatgaggttcgatacagcgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgttgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagtttagaaatattcatgccaataaaataggaaattataaatatatagttttaagcactgcatcagtgggagttcttggcttatgttagtttatgttagtttattatgaaaacatcaaagatttttttgactatattatcagttaaacaaaaaggagtcagatttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttggggggatattgtttcaatgacgctccttaagactgttgattgcccataggttccaaatagaaattaagactcatgaacatttttagaaagtagattgttttctcctggttctctaaggaactacttctgcagtcttacatagtctcatccttgtttgttgtggtgcagtcgaactcctcaggcgtttggaaagcatgtggtagaccttcttccacacccacccatacccccgttcactgcgtctggaggtcttcaacagtgaagtagggcagcccacacagcctctcaggagcacctgtccgaggcacccggagcactttgcagagcacgtccagccctcatggggtccctgcatagaaatgtgaacccctgccactgaggaagatgaaggtagaccctgtgtctggaggtgctggagggcagcgggtcacctcttgtattcccaccttagtttggggtgttttgaagaggttcagagactaaatcttaaaccttatttgaataccaacgatagctattttgggaatttcgatcttaaaaagtgacaaaacacatttcccattttcatttttcagctgaattttagtaacttatttttgatgttttaattttatcatggcctcctctttggaggccaaccttcccatgggtctcaaagcagtgacatttggtagtaaatcactgcctctcaggagtcggtatgcacaagcactcagcagccactgttgatgccttctagggaaacctaatttccgttggtaaaggtaggggcctcggaactgttccggatctgctgtagaacttcaccgtgtggaatggtgacagccacacaccgttgaccagtttagaagaggttgcattcaataaaactcttagcttgagcttatgcaatgattggttaagattttggcattgtaagaattaggagatgatcatagaaatatatgtaaagtattcaattttcaatcattttcaaattactgttataaattgtttttgctgagttgtaatacttttgagatacaatgtattccttgtactgaaagaatgaaaaaggactttttcagcatttgaggtaagttctttaacgtttcattaaaaacattttttacaaatattttgtacatgcacttgcagtattgaggttaatcattttaataaattcggaaattaaaacaa

SEQ ID NO: 30435 - DNA, 2666 bp, Homo sapiens
ttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagatcatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaagtaagtaagggagatttgataagcatatcttttaaaagtattttcacacaatttgctttataaagtgtgcttcagtagttttaaacttttaaatactcagagagactgggacttgtgagctttggctgcacttcaaggctctagacgtgatttgagtagaggcacagtctgtatcccatctctaacttcagtaccgtcctctagactatttttcttgaataccttggtaactggatatgagttcttcatcatatgttccaaggtcatcatatgttttaaacattttcaaggtgttagagactgtgatgatgtcgctaagtcctgcaagaagacaaaaggactgagtagaattaaattagactctatacattccagtgcctagccagtttgttagaaaagatgatggacttggggaattcatagcttctggccttaaggcttccaccttttcattgcttgctgacctttttcaaaacgaactgactcagttcagcagaccaccagtaccagactcagaattgtgatagaggagcattttgaacagtgccgtattgtgacatgctgtattggctactccagaaagtaggagtaaagatggaaaggagaaagaagcaacctctgagattccagtggtgtgtgggggcaagatctgatggaaactgaaaaagagaacgaagactaaacaaagagaaaggaaagagaagaaaccctaaatgggcaaaggaaagcacatcctgtttgcggagctttgaaatattggaaccatttctaattgctcctgtttttctgggtaacaccagttttctgtagttgccactaaagcagtagactcttgagtctcacttgtctctgagagagacagaagttagaaagttttgacttggcgattccgaaagtatgcctttgttggcacttaaatgtccagtgagacttcttggcaccttagagccctctgagatactgattattttaggttcttctccctactttcagatgttttcagcccaacactgggtgctctcttccactacagagaatcctgaagaaaagggaaggtgtttcccatgatggtgaatgtcactgccatgaattcctgaatctacctgctgctgggagtcagagtccaagcataacccgtgtagcataaaagcagcgctgtagccctattccagtctttttcgttaatgtccagagtgaacaacaagagttagtcaatcattaactgttgactgttgattctcataataaatgcagcataacgaccatt

SEQ ID NO: 30436 - DNA, 2869 bp, Homo sapiens
ggcacagaactcgctccccgcgcgtgcccgcgtcccgcacagagccccgtggaagcgccgcggcggctgggcctggcgggaggcgcgcgcacactgtggcagctgcgccgcacggtgtccctccgccgtcgaggccgcggccttcttttcgtatccttccaccgtgcccgggcggggtccaggcggctcaccgggggcggcgacgcggcggcggtgcgggcggcagggcagcggggcgatgaggtgaggacgcccgggaaccggaggcggcaccgcgcggcgcacggacctgggacgcggagtcctgaagccggcggacggttttcgtacgggcggccgtgcgcgaggcgaggagagaacattgaaagtattctctaagctatttgaagagagtgactaaatgcacctgggtcaggctgtctgtgggtatgaagtggttgggagaatccaagatcatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaagtaagtaagggagatttgataagcatatcttttaaaagtattttcacacaatttgctttataaagtgtgcttcagtagttttaaacttttaaatactcagagagactgggacttgtgagctttggctgcacttcaaggctctagacgtgatttgagtagaggcacagtctgtatcccatctctaacttcagtaccgtcctctagactatttttcttgaataccttggtaactggatatgagttcttcatcatatgttccaaggtcatcatatgttttaaacattttcaaggtgttagagactgtgatgatgtcgctaagtcctgcaagaagacaaaaggactgagtagaattaaattagactctatacattccagtgcctagccagtttgttagaaaagatgatggacttggggaattcatagcttctggccttaaggcttccaccttttcattgcttgctgacctttttcaaaacgaactgactcagttcagcagaccaccagtaccagactcagaattgtgatagaggagcattttgaacagtgccgtattgtgacatgctgtattggctactccagaaagtaggagtaaagatggaaaggagaaagaagcaacctctgagattccagtggtgtgtgggggcaagatctgatggaaactgaaaaagagaacgaagactaaacaaagagaaaggaaagagaagaaaccctaaatgggcaaaggaaagcacatcctgtttgcggagctttgaaatattggaaccatttctaattgctcctgtttttctgggtaacaccagttttctgtagttgccactaaagcagtagactcttgagtctcacttgtctctgagagagacagaagttagaaagttttgacttggcgattccgaaagtatgcctttgttggcacttaaatgtccagtgagacttcttggcaccttagagccctctgagatactgattattttaggttcttctccctactttcagatgttttcagcccaacactgggtgctctcttccactacagagaatcctgaagaaaagggaaggtgtttcccatgatggtgaatgtcactgccatgaattcctgaatctacctgctgctgggagtcagagtccaagcataacccgtgtagcataaaagcagcgctgtagccctattccagtctttttcgttaatgtccagagtgaacaacaagagttagtcaatcattaactgttgactgttgattctcataataaatgcagcataacgaccatt

SEQ ID NO: 30437 - DNA, 585 bp, Homo sapiens
tttttgtttttgttttggcccgagcgcatttcggagccctcccgagctcgtcctgcagcccaccctcctccccgacggcgcccctggccgtggcccggcgaccccgcggccgctgcgtcccctttgtgctttatccgctctccctgcgtcccctggagagaacattgaaagtattctctaagctatttgaagagagtgactaaatgcacctgggtcaggctgtctgtgggtatgaagtggttgggagaatccaagatcatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagt

SEQ ID NO: 30438 - DNA, 2308 bp, Homo sapiens
gagcagatgggaggtgcggcgacagtgtttgacgagagccgaaggaggctgtgggaggtgttggcggcggcggcgcgggcgcctgaggaggaggaggagaagcggatgagatcgtggggctcaccagcgtcccccatggcttctgagtagcgtgggagtggagtcagcaccaagccaggctccccgcgcctgccttgccctcacctgctcctgctctctgccagaggcagcatggtccgcagggcaccatggggcccgacagagtgacagcacgagaactgtgcgagaacgacgacctggccaccagcctcgtcctggacccctacctcggtttccgcacccataagatgaacgtcagccctgtgccccccctgcggcgacagcagcacctgcgctcagcgctggaaactttcctgaggcagcgggacctggaggctgcgtaccgggccctgacgctgggaggctggacggcccgctacttccagagccggggcccgcggcaggaggctgccctcaagacccacgtctatcgctacctccgtgccttcctgccggaaagtggctttaccatcctgccctgcacgcgctactccatggagaccaacggggccaagatcgtgtccactcgtgcttggaaaaagaatgagaagctggagctgctggtgggctgcattgcagagctgcgggaggcagatgaggggctgctgagggccggtgagaatgacttcagcatcatgtactcaacccgcaagcggagtgctcagctgtggctgggcccagccgccttcatcaaccatgactgcaaacccaactgcaagtttgtgcctgcagatgggaacgcagcctgcgtgaaggtgctccgggacattgagcctggggacgaggtgacatgcttctacggcgagggcttcttcggcgagaagaatgagcactgtgaatgccacacctgtgagaggaaaggtgaaggagctttccgaaccaggcctagggagcccgcgttgccaccacggcccctggacaagtaccagctgcgtgagaccaagcggcggctgcagcaaggcctggacagtggcagccgacagggcctgctgggccctcgggcctgcgtgcacccatccccgctgcgccgggacccattctgcgccgcctgccagcccctgcgcctgccagcctgcagcgcccgcccagacacctcacccctctggctccagtggctgcctcagccccagccccgagtgcggccccggaagcgccgacgcccccggccccggagggccccagtgctctccacccaccacgctgcccgcgtctccctgcaccgatggggaggctgtggcccccactgccgcctgcgaggagaggccctggtggccctgggccagcccccccacgcccgctgggcccctcagcaggactggcactgggcccggcgctatgggctgccttacgtggtgcgtgtggaccttcgtcgcctggccccagccccaccagctaccccagcccctgctgggaccccaggccccatcctgatcccgaagcaggccctcgccttcgcccccttctccccacccaagcgcctacggctggtggtcagccacggctccatcgacctggatgtcggcggtgaagagctgtgacaggccggacggggaggcccagcagggagagagggtctctctcctagctgctacccaggacctccagaaggagcccttggacctctgggagggagctgacccttgactccagcatagctctgaccctggaatggggttggtttggacacccccagggatctgagccctgaccctttgtgactgctgacccctgagccacccccactcccacagggagccccggccatttgctgccctccccacccctgccccagcctcaggactgcaggagccatccgcccccctcagccccttcctccccagggagcaaagccataaggggcaggggccaccccacggcatctccccagaagtacaggcctcaggaggaggtggaactgatgtagggggtggcactccccagagactgccctcacgaggggactgggttcgctctcagctctgcagctgtctgcggtggggggaaggttggggggtgtctggaggcatgttcccctcaccaccccccgtgggtctcagggaggccgggtgtgacctcatctttctcatggtgctatcctggtgctattggggtggggagctccctcccctcccccacaccagaaaggggtatgttgggggcttggaagcacttgaactttttattttattaaaaccttgttataagcagc

SEQ ID NO: 30439 - DNA, 888 bp, Homo sapiens
gagagccgaaggaggctgtgggaggtgttggcggcggcggcgcgggcgcctgaggaggaggaggagaagcggatgagatcgtggggctcaccagcgtcccccatggcttctgagtagcgtgggagtggagtcagcaccaagccaggctccccgcgcctgccttgccctcacctgctcctgctctctgccagaggcagcatggtccgcagggcaccatggggcccgacagagtgacagcacgagaactgtgcgagaacgacgacctggccaccagcctcgtcctggacccctacctcggtttccgcacccataagatgaacgtcagcccccggccttgcagggaacaacgcaggcagctgtggtggcaggagcagggaggccagagagccccaggggccaggactcaggatgctgtccagacatgcccaggagaggccgctggttgtcctgtagcccggaagcagaaggaatcaggagggttggctccagggcggcattgagggtgcaccctctggagcacagacctcgatggggcaccccgggaggcatgacaaagggatccagatttttggctccagagtcagaactgagttggggtcctggcgatgccacccctggcctttggtttttcatctcagatggggttggtgaggatctctggaactctgcgggctggtcaagtgtgccggagggttttggacagcgaatgcgtggccctggtctgacaccacacacagacgctgggggggatggaaacaaaaggcggcattcggagaggctctgcagggccagtgtgctccagccaccttgagcacacgagagggcggccagctctccagcgatctagaaccatctggcttcacagaagccatgctgggcatcgacgga

SEQ ID NO: 30440 - DNA, 957 bp, Homo sapiens
gggagagaggataaatagcagcgtggcttccctggctcctctctgcatccttcccgaccttcccagcaatatgcatcttgcacgtctggtcggctcctgctccctccttctgctactgggggccctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacaggccgggaaggaagcagacaaagcggtccaagggttccacactggggtccaccaggctgggaaggaagcagagaaacttggccaaggggtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcggtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacacta

SEQ ID NO: 30441 - DNA, 1945 bp, Homo sapiens
tctgcatccttcccgaccttcccagcaatatgcatcttgcacgtctggtcggctcctgctccctccttctgctactgggggccctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacaggttgggaaggaggcagacaaactgatccatcatggggtccatcacggggccaaccaggcgggaagtgaggcagggaagtttggccagggagtcgacaatgctgcagggcaggctggaaatgaggctgggaggtttggccagggagtccaccatgctgcagggcaggccggaaatgaggctgggaggtttggccagggagtccaccatgctgcagggcaggccggaaatgaggctgggagatttggccagggggcccaccatggtctcagtgagggctggaaggagacagagaagtttggccaggggatccaccatgctgccggtcaggttgggaaggaggcagagaagtttggccagggggcccaccatgctgcggggcaggccggaaatgaggcagggagatttggccagggggtccaccatggtctcagtgagggctggaaggagacagagaagtttggccagggggtccaccatactgctggtcaggttgggaaggaggcagagaagtttggccagggggcccaccatgctgcggggcaggccggaaatgaggcagggagatttggccagggggcccaccatgctgcggggcaggccggaaatgaggctgggaggtttggccagggggtccaccatggtctcagtgagggctggaaggagacagagaagtttggccagggggtccaccatgctgccagtcagtttgggaaggaaacagagaagctcggccatggggtccaccatggggttaatgaggcctggaaggaagcagagaagtttggccagggtgtccaccatgctgcctcgcaggtggggaaggaggaagacagagtggtccaaggcctccatcatggcgttagtcaggctggaagggaggcggggcagtttggccacgacattcaccacacagcagggcaggctgggaaagagggagacatagcagttcatggtgtccaacctggggtccacgaggccgggaaggaggcagggcagtttggccagggagttcaccatacccttgaacaggccgggaaggaagcagacaaagcggtccaagggttccacactggggtccaccaggctgggaaggaagcagagaaacttggccaaggggtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcggtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacacta

SEQ ID NO: 30442 - DNA, 593 bp, Homo sapiens
ggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacagggcaaccatcaaagcggatcttccagccatcaaggaggggccacaaccacgccgttagcctctggggcctcggtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacacta

SEQ ID NO: 30443 - DNA, 865 bp, Homo sapiens
gacttggaggcagagacccaagcagctggaggctctgtgtgtggcctggagaccccacaacctccagccggaggcctgaagcatgaggccatgccaggtgccaggagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctag

SEQ ID NO: 30444 - DNA, 1015 bp, Homo sapiens
ttggaggcagagacccaagcagctggaggctctgtgtgtgggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgc

SEQ ID NO: 30445 - DNA, 2160 bp, Homo sapiens
gagacccaagcagctggaggctctgtgtgtgggtcgctgatttcttggagcctgaaaagaaagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacaccaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttca

SEQ ID NO: 30446 - DNA, 2212 bp, Homo sapiens
gacttggaggcagagacccaagcagctggaggctctgtgtgtgggtcgctgatttcttggagcctgaaaagaaagtaacacagcagggatgaggacagatggtgtgagtcagtgagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacaccaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttc

SEQ ID NO: 30447 - DNA, 953 bp, Homo sapiens
gaggcagagacccaagcagctggaggctctgtgtgtggcctggagaccccacaacctccagccggaggcctgaagcatgaggccatgccaggtgccaggagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctag

SEQ ID NO: 30448 - DNA, 2141 bp, Homo sapiens
gacttggaggcagagacccaagcagctggaggctctgtgtgtgggagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacaccaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttc

SEQ ID NO: 30449 - DNA, 527 bp, Homo sapiens
gacccaagcagctggaggctctgtgtgtgggagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagca

SEQ ID NO: 30450 - DNA, 596 bp, Homo sapiens
cccaagcagctggaggctctgtgtgtgggtcgctgatttcttggagcctgaaaagaaagtaacacagcagggatgaggacagatggtgtgagtcagtgagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagca

SEQ ID NO: 30451 - DNA, 2189 bp, Homo sapiens
gagacccaagcagctggaggctctgtgtgtgggtcgctgatttcttggagcctgaaaagaaggagcagcgactggacccagagccatgtggctgtgccctctggccctcaccctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataataaatcgttagtgtgttcacatgagtttccata

SEQ ID NO: 30452 - DNA, 1425 bp, Homo sapiens
cagagacccaagcagctggaggctctgtgtgtgggagcagcgactggacccagagccatgtggctgtgccctctggccctcaccctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactg

SEQ ID NO: 30453 - DNA, 726 bp, Homo sapiens
cagagacccaagcagctggaggctctgtgtgtggatccatccctaccagggactcagcagggcctaagcagggggagtgggagaacagaccccaagaggaaggaagacctcatcactgactgtgagagggtcatcaccccccgatgatcaccttgaagggtccaggctgtgggccctattcatctcttttcattctcaggtcgctgatttcttggagcctgaaaagaaggagcagcgactggacccagagccatgtggctgtgccctctggccctcaccctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagca

SEQ ID NO: 30454 - DNA, 2002 bp, Homo sapiens
atgaggccatgccaggtgccaggagcagcgactggacccagagccatgtggctgtgccctctggccctcaccctcatcttgatggcagcctctggtgctgcgtgcgaagtgaaggacgtttgtgttggaagccctggtatccccggcaagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataataaatcgttagtgtgttcacatgagtttccata

SEQ ID NO: 30455 - DNA, 3664 bp, Homo sapiens
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattg

SEQ ID NO: 30456 - DNA, 1281 bp, Homo sapiens
tttgcttggagctcctggggcctaacaaaaagaaacctgccatgctgctcttcctcctctctgcactggtcctgctcacacagcccctgggctacctggaagcagaaatgaagacctactcccacagaacaatgcccagtgcttgcaccctggtcatgtgtagctcagtggagagtggcctgcctggtcgcgatggacgggatgggagagagggccctcggggcgagaagggggacccaggtttgccaggagctgcagggcaagcagggatgcctggacaagctggcccagttgggcccaaaggggacaatggctctgttggagaacctggaccaaagggagacactgggccaagtggacctccaggacctcccggtgtgcctggtccagctggaagagaaggtcccctggggaagcaggggaacataggacctcagggcaagccaggcccaaaaggagaagctgggcccaaaggagaagtaggtgccccaggcatgcagggctcggcaggggcaagaggcctcgcaggccctaagggagagcgaggtgtccctggtgagcgtggagtccctggaaacacaggggcagcagggtctgctggagccatgggtccccagggaagtccaggtgccaggggacccccgggattgaagggggacaaaggcattcctggagacaaaggagcaaagggagaaagtgggcttccagatgttgcttctctgaggcagcaggttgaggccttacagggacaagtacagcacctccaggctgctttctctcagtataagaaagttgagctcttcccaaatggccaaagtgtcggggagaagattttcaagacagcaggctttgtaaaaccatttacggaggcacagctgctgtgcacacaggctggtggacagttggcctctccacgctctgccgctgagaatgccgccttgcaacagctggtcgtagctaagaacgaggctgctttcctgagcatgactgattccaagacagagggcaagttcacctaccccacaggagagtccctggtctattccaactgggccccaggggagcccaacgatgatggcgggtcagaggactgtgtggagatcttcaccaatggcaagtggaatgacagggcttgtggagaaaagcgtcttgtggtctgcgagttctgagccaactggggtgggtggggcagtgcttggcccaggagtttggccagaagtcaaggcttagaccctcatgctgccaatatcctaataaaaaggtgaccatctgtgccgggaa

SEQ ID NO: 30457 - DNA, 659 bp, Homo sapiens
agacatgtttctcagcacctccaaacatgggcggcaagaggccatgctgctcttcctcctctctgcactggtcctgctcacacagcccctgggctacctggaagcagaaatgaagacctactcccacagaacaatgcccagtgcttgcaccctggtcatgtgtagctcagtggagagtggcctgcctggtcgcgatggacgggatgggagagagggccctcggggcgagaagggggacccaggtttgccaggagctgcagggcaagcagggatgcctggacaagctggcccagttgggcccaaaggggacaatggctctgttggagaacctggaccaaagggagacactgggccaagtggacctccaggacctcccggtgtgcctggtccagctggaagagaaggtcccctggggaagcaggggaacataggacctcagggcaagccaggcccaaaaggagaagctgggcccaaaggagaagtaggtgccccaggcatgcagggctcggcaggggcaagaggcctcgcaggccctaagggagagcgaggtgtccctggtgagcgtggagtccctggaaacacaggggcagcagggtctgctggagccatgggtccccagggaagtccaggtgccaggggacccccgggattgaaggggg

SEQ ID NO: 30458 - DNA, 1093 bp, Homo sapiens
gcgtcccggaagcgcccgcggggccgggtgcgatggcggcggtggctgcgttgcagctggggctgcgggcggcggggctgggacgggccccggccagcgccgcctggaggagcgtcctcagggtctccccgcgcccaggggtggcctggaggccaagcagatgtggcagttctgcagcagaagcatctgccacaaaagcggaagatgactcctttcttcagtgggtcctgctcctcatccctgtgactgcctttggcttggggacatggcaggtccagcgtcggaagtggaagctgaacctgattgcagagttggagtccagagttctggctgagcctgtccctctgccagccgacccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctgggagtcaccatcctggtaaatagagggttcgttcccaggaagaaagtgaatcctgaaacccggcagaaaggccagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctaccttaaatgagctcatgactggttcatcataaaatcctggcttggtttcagtccaaagaa

SEQ ID NO: 30459 - DNA, 813 bp, Homo sapiens
gccccggccagcgccgcctggaggagcgtcctcagggtctccccgcgcccaggggtggcctggaggccaagcagatgtggcagttctgcagcagaagcatctgccacaaaagcggaagatgactcctttcttcagtgggtcctgctcctcatccctgtgactgcctttggcttggggacatggcaggtccagcgtcggaagtggaagctgaacctgattgcagagttggagtccagagttctggctgagcctgtccctctgccagccgacccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctggggaagaaagtgaatcctgaaacccggcagaaaggccagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtga

SEQ ID NO: 30460 - DNA, 842 bp, Homo sapiens
gcgagcggcttccgccgggctgctccgcgggcgcgtcggccatgagcgagttgccgggcgacgtgcgggcgtttctgcgggagcacccgagcctgcggctccagacggacgcccgcaaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgcaccagttgttctgcaaactcaccctgcggcacatcaacaagtgcccagaacacgtgctgaggcacacccagggccggcggtaccagcgagctctgtgtaaatatgaagaatgtcagaagcaaggggtggagtacgtgcctgcctgcctggtgcaccggaggaggaggagggaggaccagatggacggtgacgggcctcgcccgcgggaagccttctgggagcccacatccagtgatgaggggggagctgcaagtgatgacagcatgacagacctgtacccacctgagctattcaccagaaaggaccttggaagcacggaggatggggatggcactgatgactttttgacagacaaagaggatgagaaggcaaagcccccaagagagaaggccactgatgagagcaggagagagacgaccgtgtaccgagggctggtccagaagcgcgggaagaagcagttgggctcgttgaaaaagaagttcaagagtcatcaccgcaaacccaagagcttcagctcctgtaaacagccaggttaataaaagcacatgccgtgaagtttcgagaaa

SEQ ID NO: 30461 - DNA, 2984 bp, Homo sapiens
ggagccgcagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgtatgcagtgtgatccta

SEQ ID NO: 30462 - DNA, 715 bp, Homo sapiens
cagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctcagccgtctcagcagtagctacatcagcctgatggatagagacttcatgacgtgcagcagctggaacttttgtttataaagcatctcttttcctcaca

SEQ ID NO: 30463 - DNA, 2624 bp, Homo sapiens
ggagccgcagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacatacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgtatgcagtgtgatccta

SEQ ID NO: 30464 - DNA, 1465 bp, Homo sapiens
ggcgtttggagctgctggggggtccccgcacgtttttcctctcactggggctcccggaggcgggctgggagctcggggacgaacgggggccgggggtcctcccagaggaaagggggcgcgctggcgtgcgccccagctacaggaagccacagcaccttttccttttctctttcccagatgtgctggactcttggggtccctttgaccctgtctgcgtctccctccccgtttggactctgccctgggctggattgagtggggacctgtacacagcctgggaggaggggaagcctatctccctgatagtctccttccagaagtgtccaggtggcattctgagcaacagaaaacaagagcaaaactgaagtgacaagatttgaccagaaagtgtgggctgctgaaagcaagacctaatgtgaagagaaagtggagttttctgtgtggcgtgggagctgcaggtggctgtgacagtgatcactggatgcccaggaagtcatctcaggcccctcagatgctgtcactgcttatgaaccatatcctgcttgatggcgcggttctcggagagacttaatgagaagcttggccacagagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctccctt

SEQ ID NO: 30465 - DNA, 1018 bp, Homo sapiens
cttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgagattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgag

SEQ ID NO: 30466 - DNA, 2505 bp, Homo sapiens
gggtgattgaggcactgaggccaggccccgggggtgccctgctgcaccgactccgggcggagattggctgtcctcggcccgcaatgctgtgcgccccgccccgcgcgccgcttccggcggagtcaggcttggctaatcgagcgcgcgggctggcggctcggcgttcgtttggccgcgcctgcccgtgtggtggtttccggcggaggtggtgagagtcgcacgcgcagcggggaaggtgtgagtcgtgaacggcccgggtctccgccatggcctctctactcgccaaggacgcctacctgcagagcctggccaagaagatctgctcccattcggccccggaacagcaggcgcgcacgcgggctggcaaaactcaaggctcagaaactgcagggcccccaaaaaagaaaaggaagaaaacacaaaagaaattccggaagcgagaagagaaggctgctgagcacaaggccaagtccttgggggagaaatctccagcagcctctggggccaggaggcctgaggcagccaaagaggaagcagcttgggcttccagctcagcagggaaccctgcagatggcctggccactgagcctgagtctgtctttgctctggatgttctgcgacagcgactgcatgagaagatccaggaggcccggggccagggcagtgccaaggagctgtcccctgccgccttggagaaaaggcggcggagaaagcaggaacgggaccggaagaagaggaagcgaaaggagctgcgggcgaaagagaaggccaggaaggctgaggaggccacggaggcccaggaggtggtggaggcaaccccagagggggcctgcacggagccgcgggagccgcccgggctgatcttcaataaggtggaggtgagcgaagacgagccggccagcaaggcgcagcgcagaaaagagaagaggcagagggtgaaggggaacctcacgccgctgaccgggaggaactaccggcagctgctggagcgcctgcaggcacggcagagccggctggacgagctgcgcggccaggatgaggggaaggcgcaggagctggaggcgaagatgaagtggaccaacctcctctacaaggcggagggcgtgaagatccgtgacgacgaacgcctgctgcaggaggccctgaagcgcaaggagaagcgcagggcgcagcggcagcgccggtgggagaagcgcacggccggcgtggtggagaagatgcagcagcgccaggaccggcggcggcagaacctgcgcaggaagaaggcggcccgcgccgagcgccgcctgctcagagcccgcaagaagggccgcatcctgccgcaggacctggagcgcgcaggcctggtctgagtctttcccacctggggccgccgtcttccgtcctaggagactccaggacaccctctgagtccttgacgctggctctgtcccaggatctccacagacctcggcctctccatgtgagggggacacagtggtgctctgctgagttgtgagggcccagatcacagatcccatgtgagaaagagagagtttcagcgtcatccttgaacgcaggatccgggaccttcagacccagggaaagggtgagggagactggggcctggtctgctttcccgggcctgaaagcttccccgaggtttgcagggtcagggaggaggaacggtgggggtgggcagtcactgcctgttccccactgcctgtgttcgcaggagccacgggacagaagacggtggcctctgctgccgggccacgttagtccgcagctcacccgaacagaggacaaccctgaggtgtggcatatgggcacctggcactgggagtcgggggagcacgtccaggcgtggtgcatcctggggcagaacgccatggctcctccccgctctcttggcttctgcctgttggggtctcattcctttctgttccccagtgccccggggcggcattttactgctcagaatttggagggagggagcagtaccttcccggagtccacgcatgtgagttgggtcaagtgcattggacctagggaaagagaaagaaagaataaaagctggagagagagtgaagtgaatgcaagataaaaagtgggatggaagaattaaatccagagttccaggcaatcaaaatgagtgcaggttgaaagaaaacaggtgaattttagtggcatatggatgataaagctgtaaataaaattcttttgatgaaactctccggttacgagacaaagactgtaactgaacaggagctggtgtgactgttaccagacagaggcaactgatgaaaaagccctgtgaaagataggatgtgaggtgagcatgagcttgagctgagagacagacacaacagtatctgaaaagaatacatactctttccatgcatatatggaacatggatggaaactgaccacctactttgtccagaaaagaagtcttaagatatttcaaggaatcagtgtcgttatctgaccgtatcccaatgtcattaaaaaaaatttgagcta

SEQ ID NO: 30467 - DNA, 1531 bp, Homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatt

SEQ ID NO: 30468 - DNA, 1536 bp, Homo sapiens
agaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaa

SEQ ID NO: 30469 - DNA, 1219 bp, Homo sapiens
agaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttaaaaagttgaaaggttaatgtaaaacaatcaatattaaagaattttgatgccaaaactattagataaaaggttaatctacatccctactagaattctcatacttaactggttggttatgtggaagaaacatactttcacaataaagagctttaggatatgatgccattttatatcactagtaggcagaccagcagacttttttttattgtgatatgggataacctaggcatactgcactgtacactctgacatat

SEQ ID NO: 30470 - DNA, 1445 bp, Homo sapiens
gggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattagctgtatctgtgattgtatttcttt

SEQ ID NO: 30471 - DNA, 1550 bp, Homo sapiens
gccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgacagggtttcactgtgttagccaggatggtctcaatctcctgaccccgtgatccacccgcctcggccttccaagagaaatgaaatttttttaatgcacaaagatctggggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattag

SEQ ID NO: 30472 - DNA, 1308 bp, Homo sapiens
actcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttaaaaagttgaaaggttaatgtaaaacaatcaatattaaagaattttgatgccaaaactattagataaaaggttaatctacatccctactagaattctcatacttaactggttggttatgtggaagaaacatactttcacaataaagagctttaggatatgatgccattttatatcactagtaggcagaccagcagacttttttttattgtgatatgggataacctaggcatactgcactgtacactctgacatatgaagtgctctagtcaagtttaactggtgtccacagaggacatggtttaactggaattcgtcaagcctctggttctaatttctcatttgcaggaaatgctggcatagagcagcactaaatgacaccactaaagaaacgatcagacagatctggaatgtgaagcgttatagaagataactggcctcatttcttcaaaatatcaagtgttgggaaagaaaaaa

SEQ ID NO: 30473 - DNA, 1573 bp, Homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatt

SEQ ID NO: 30474 - DNA, 1388 bp, Homo sapiens
gctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaa

SEQ ID NO: 30475 - DNA, 1536 bp, Homo sapiens
agaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaa

SEQ ID NO: 30476 - DNA, 1550 bp, Homo sapiens
gccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgacagggtttcactgtgttagccaggatggtctcaatctcctgaccccgtgatccacccgcctcggccttccaagagaaatgaaatttttttaatgcacaaagatctggggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattag

SEQ ID NO: 30477 - DNA, 867 bp, Homo sapiens
actcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttagaaagttgaaaggttaatgtaaaacaatcaata

SEQ ID NO: 30478 - DNA, 6192 bp, Homo sapiens
cttacagggcccttccattattgaatgcacggcttctggcatctgggacagagcgccacctgcctgtcacctcgtcttctgtggagaaccacctgccatcaaagatgctgtcattacggggaataacttcactttcaggaacaccgtcacttacacttgcaaagaaggctatactcttgctggtcttgacaccattgaatgcctggccgacggcaagtggagtagaagtgaccagcagtgcctggctgtctcctgtgatgagccacccattgtggaccacgcctctccagagactgcccatcggctctttggagacattgcattctactactgctctgatggttacagcctagcagacaattcccagcttctctgcaatgcccagggcaagtgggtacccccagaaggtcaagacatgccccgttgtatagctcatttctgtgaaaaacctccatcggtttcctatagcatcttggaatctgtgagcaaagcaaaatttgcagctggctcagttgtgagctttaaatgcatggaaggctttgtactgaacacctcagcaaagattgaatgtatgagaggtgggcagtggaacccttcccccatgtccatccagtgcatccctgtgcggtgtggagagccaccaagcatcatgaatggctatgcaagtggatcaaactacagttttggagccatggtggcttacagctgcaacaaggggttctacatcaaaggggaaaagaagagcacctgcgaagccacagggcagtggagtagtcctataccgacgtgccacccggtatcttgtggtgaaccacctaaggttgagaatggctttctggagcatacaactggcaggatctttgagagtgaagtgaggtatcagtgtaacccgggctataagtcagtcggaagtcctgtatttgtctgccaagccaatcgccactggcacagtgaatcccctctgatgtgtgttcctctcgactgtggaaaacctcccccgatccagaatggcttcatgaaaggagaaaactttgaagtagggtccaaggttcagtttttctgtaatgagggttatgagcttgttggtgacagttcttggacatgtcagaaatctggcaaatggaataagaagtcaaatccaaagtgcatgcctgccaagtgcccagagccgcccctcttggaaaaccagctagtattaaaggagttgaccaccgaggtaggagttgtgacattttcctgtaaagaagggcatgtcctgcaaggcccctctgtcctgaaatgcttgccatcccagcaatggaatgactctttccctgtttgtaagattgttctttgtaccccacctcccctaatttcctttggtgtccccattccttcttctgctcttcattttggaagtactgtcaagtattcttgtgtaggtgggtttttcctaagaggaaattctaccaccctctgccaacctgatggcacctggagctctccactgccagaatgtgttccagtagaatgtccccaacctgaggaaatccccaatggaatcattgatgtgcaaggccttgcctatctcagcacagctctctatacctgcaagccaggctttgaattggtgggaaatactaccaccctttgtggagaaaatggtcactggcttggaggaaaaccaacatgtaaagccattgagtgcctgaaacccaaggagattttgaatggcaaattctcttacacggacctacactatggacagaccgttacctactcttgcaaccgaggctttcggctcgaaggtcccagtgccttgacctgtttagagacaggtgattgggatgtagatgccccatcttgcaatgccatccactgtgattccccacaacccattgaaaatggttttgtagaaggtgcagattacagctatggtgccataatcatctacagttgcttccctgggtttcaggtggctggtcatgccatgcagacctgtgaagagtcaggatggtcaagttccatcccaacatgtatgccaatagactgtggcctccctcctcatatagattttggagactgtactaaactcaaagatgaccagggatattttgagcaagaagacgacatgatggaagttccatatgtgactcctcaccctccttatcatttgggagcagtggctaaaacctgggaaaatacaaaggagtctcctgctacacattcatcaaactttctgtatggtaccatggtttcatacacctgtaatccaggatatgaacttctggggaaccctgtgctgatctgccaggaagatggaacttggaatggcagtgcaccatcctgcatttcaattgaatgtgacttgcctactgctcctgaaaatggctttttgcgttttacagagactagcatgggaagtgctgtgcagtatagctgtaaacctggacacattctagcaggctctgacttaaggctttgtctagagaatagaaagtggagtggtgcctccccacgctgtgaagccatttcatgcaaaaagccaaatccagtcatgaatggatccatcaaaggaagcaactacacatacctgagcacgttgtactatgagtgtgaccccggatatgtgctgaatggcactgagaggagaacatgccaggatgacaaaaactgggatgaggatgagcccatttgcattcctgtggactgcagttcacccccagtctcagccaatggccaggtgagaggagacgagtacacattccaaaaagagattgaatacacttgcaatgaagggttcttgcttgagggagccaggagtcgggtttgtcttgccaatggaagttggagtggagccactcccgactgtgtgcctgtcagatgtgccaccccgccacaactggccaatggggtgacggaaggcctggactatggcttcatgaaggaagtaacattccactgtcacgagggctacatcttgcacggtgctccaaaactcacctgtcagtcagatggcaactgggatgcagagattcctctctgtaaaccagtcaactgtggacctcctgaagatcttgcccatggtttccctaatggtttttcctttattcatgggggccatatacagtatcagtgctttcctggttataagctccatggaaattcatcaagaaggtgcctctccaatggctcctggagtggcagctcaccttcctgcctgccttgcagatgttccacaccagtaattgaatatggaactgtcaatgggacagattttgactgtggaaaggcagcccggattcagtgcttcaaaggcttcaagctcctaggactttctgaaatcacctgtgaagccgatggccagtggagctctgggttcccccactgtgaacacacttcttgtggttctcttccaatgataccaaatgcgttcatcagtgagaccagctcttggaaggaaaatgtgataacttacagctgcaggtctggatatgtcatacaaggcagttcagatctgatttgtacagagaaaggggtatggagccagccttatccagtctgtgagcccttgtcctgtgggtccccaccgtctgtcgccaatgcagtggcaactggagaggcacacacctatgaaagtgaagtgaaactcagatgtctggaaggttatacgatggatacagatacagatacattcacctgtcagaaagatggtcgctggttccctgagagaatctcctgcagtcctaaaaaatgtcctctcccggaaaacataacacatatacttgtacatggggacgatttcagtgtgaataggcaagtttctgtgtcatgtgcagaagggtatacctttgagggagttaacatatcagtatgtcagcttgatggaacctgggagccaccattctccgatgaatcttgcagtccagtttcttgtgggaaacctgaaagtccagaacatggatttgtggttggcagtaaatacacctttgaaagcacaattatttatcagtgtgagcctggctatgaactagaggggaacagggaacgtgtctgccaggagaacagacagtggagtggaggggtggcaatatgcaaagagaccaggtgtgaaactccacttgaatttctcaatgggaaagctgacattgaaaacaggacgactggacccaacgtggtatattcctgcaacagaggctacagtcttgaagggccatctgaggcacactgcacagaaaatggaacctggagccacccagtccctctctgcaaaccaaatccatgccctgttccttttgtgattcccgagaatgctctgctgtctgaaaaggagttttatgttgatcagaatgtgtccatcaaatgtagggaaggttttctgctgcagggccacggcatcattacctgcaaccccgacgagacgtggacacagacaagcgccaaatgtgaaaaaatctcatgtggtccaccagctcacgtagaaaatgcaattgctcgaggcgtacattatcaatatggagacatgatcacctactcatgttacagtggatacatgttggagggtttcctgaggagtgtttgtttagaaaatggaacatggacatcacctcctatttgcagagctgtctgtcgatttccatgtcagaatgggggcatctgccaacgcccaaatgcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctctaccctcacaaaatgtacatattctgctgtctattgggaaagttcctggtacacatttttattcagttacttaaaatgatttttccattaaagtatattttgctactaaataatattttgctggatagtaccattttatgaggtggccaagggattcatagagaggactcatgatctttcatctgtgccactggcaccacataggagaccccttacaataaaggagacccctttgttctggttccatcttctatacaatatgtgtaataataaaagctttttctttcatttaatcaatcagagagtaactgttggacctggtactctccaccacataattatgtcctggtacttagggtagcctggctaattcttttcacaacatttgaaaagccgtaggcattaacttcatggatgtggagaaacagcataatgaccttggttcacaatgaaagtgctagccttctttctcgtggctggaataagaaatgcaagaactggaagattaacaaagagctgatacccggactggtaatcccacaactcactattttgggaggaaggggaagacagggaaagagaaggaaaaaggcaaatgggaaacattccccagagctgtgctcctggtctcacctgcaaaaaagaattgcagccacctaagagaaagctgagctgcccctcagtcctcactgtcacctacctctatcacaacaattgtaccaagatgaagccttccccagacttcagaaaataaagtcaaaccctagattttgttttaaaataggaaactcagaatcaacttgcctccatcctctgggaaaactgctcccacacaggccttggagtgtgttgtagcactgtggaggaatgcagaaaggatgaaagagatcttgattctcctagtggttctcttcactaccgtaggcatccctcagccattgactcctccttctttctcttgacattcactttcttggccagtcttacatgcttatgagtctactttccaataaatttactcatagtccattaa

SEQ ID NO: 30479 - DNA, 5705 bp, Homo sapiens
atgtggcctcgcctggccttttgttgctggggtctggcgctcgtttcgggctgggcgacctttcagcagatgtccccgtcgcgcaatttcagcttccgcctcttccccgagaccgcgcccggggcccccgggagtatccccgcgccgcccgctcctggcgacgaagcggcggggagcagagtggagcggctgggccaggcgttccggcgacgcgtgcggctgctgcgggagctcagcgagcgcctggagcttgtcttcctggtggatgattcgtccagcgtgggcgaagtcaacttccgcagcgagctcatgttcgtccgcaagctgctgtccgacttccccgtggtgcccacggccacgcgcgtggccatcgtgaccttctcgtccaagaactacgtggtgccgcgcgtcgattacatctccacccgccgcgcgcgccagcacaagtgcgcgctgctcctccaagagatccctgccatctcctaccgaggtggcggcacctacaccaagggcgccttccagcaagccgcgcaaattcttcttcatgctagagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggaccaggtggctggggtgcagctaataggctggattactcttacgatgacttcctggacactgtgcaagaaacagccacaagcatcggcaatgccaagtcctcacggattaaaagaagtgccccattatctgactataaaattaagttaatttttaacatcacagctagtgtgccattacccgatgaaagaaatgatacccttgaatgggaaaatcagcaacgactccttcagacattggaaactatcacaaataaactgaaaaggactctcaacaaagaccccatgtattcctttcagcttgcatcagaaatacttatagccgacagcaattcattagaaacaaaaaaggcttcccccttctgcagaccaggctcagtgctgagagggcgtatgtgtgtcaattgccctttgggaacctattataatctggaacatttcacctgtgaaagctgccggatcggatcctatcaagatgaagaagggcaacttgagtgcaagctttgcccctctgggatgtacacggaatatatccattcaagaaacatctctgattgtaaagctcagtgtaaacaaggcacctactcatacagtggacttgagacttgtgaatcgtgtccactgggcacttatcagccaaaatttggttcccggagctgcctctcgtgtccagaaaacacctcaactgtgaaaagaggagccgtgaacatttctgcatgtggagttccttgtccagaaggaaaattctcgcgttctgggttaatgccctgtcacccatgtcctcgtgactattaccaacctaatgcagggaaggccttctgcctggcctgtcccttttatggaactaccccattcgctggttccagatccatcacagaatgttcaagttttagttcaactttctcagcggcagaggaaagtgtggtgccccctgcctctcttggacatattaaaaagaggcatgaaatcagcagcagagttttccatgaatgcttctttaacccttgccacaatagtggaacctgccagcaacttgggcgtggttatgtttgtctctgtccacttggatatacaggcttaaagtgtgaaacagacatcgatgagtgcagcccactgccttgcctcaacaatggagtttgtaaagacctagttggggaattcatttgtgagtgcccatcaggttacacaggtcagcggtgtgaagaaaatataaatgagtgtagctccagtccttgtttaaataaaggaatctgtgttgatggtgtggctggctatcgttgcacatgtgtgaaaggatttgtaggcctgcattgtgaaacagaagtcaatgaatgccagtcaaacccatgcttaaataatgcagtctgtgaagaccaggttgggggattcttgtgcaaatgcccacctggatttttgggtacccgatgtggaaagaacgtcgatgagtgtctcagtcagccatgcaaaaatggagctacctgtaaagacggtgccaatagcttcagatgcctgtgtgcagctggcttcacaggatcacactgtgaattgaacatcaatgaatgtcagtctaatccatgtagaaatcaggccacctgtgtggatgaattaaattcatacagttgtaaatgtcagccaggattttcaggcaaaaggtgtgaaacagaacagtctacaggctttaacctggattttgaagtttctggcatctatggatatgtcatgctagatggcatgctcccatctctccatgctctaacctgtaccttctggatgaaatcctctgacgacatgaactatggaacaccaatctcctatgcagttgataacggcagcgacaataccttgctcctgactgattataacggctgggttctttatgtgaatggcagggaaaagataacaaactgtccctcggtgaatgatggcagatggcatcatattgcaatcacttggacaagtgccaatggcatctggaaagtctatatcgatgggaaattatctgacggtggtgctggcctctctgttggtttgcccatacctggtatgttttaacaaaatgagtataattctgttggactctagaggtgatgctgcttaaatggacatcaggtttgctagcattgttgttcttggtttcaaacaaagattaacagctatctctcttatttcctactccctgattatcctaactgtgggttattagaagcttttttcctaagtaagctgtttgcctctctgtgtgagaaatgcctttgaagatctacattaagactaccaagaagcatgctgaattagcagctggttgctaaactgtcttctaaggagattaattactggtattttttgtttattttaaggattgttttgttttgtaatcagtatataagcaggaccactgctatccatcttttatggcccttttcaaatagatcttggcttgtcttctaaaaaatactttttaataaatatcccaggagttttagtttgaagaattgcaaactaaatttcattaggtgacccaggttctcagcattgtacatggcaataagcttgttctatctggatacatctatagaagtatatgcatatgacattattttttactttgctcatttgtttcaggtatactaaaagaaaattaaatagacaaaaatgaattaaagtattagaaactgactaatacattctagaagtaagttgtatgaaactaggatacgtatactaataaatatagcacaaaaatactaaacttcataaaaatgcggtgagatgacccttgcgaagcctcaaatacaatacttattttatttattagaaattattggccaggtacggtggctcacgcctgtaatcccagcactttggaaggctgaggagggtggatcacgaggtcaggagttggagaccgccctggacaatatggtgaagccctatctctactaaaaacgcacagaaaaattagccaggcatggtggtagatgcctgtaattccagctactcaggaggctgaggcaggagaatcgcttgaacccaggaggcgaagattgccgtgagccgagatcatgccactgcactccagcctgggcaatggagagaggctctgtctc

SEQ ID NO: 30480 - DNA, 3257 bp, Homo sapiens
agggagagaaggagggaagcgggagatttttcttgactgccccctttccttcaaacattttataggcttcagggagagagaggaggaggagagagggaagaaaaaaagaggagagcgagaggggtagagagcgcgcgccgttccctccggagttcccgagctgctgaggagtctggattgtgtctgtccccagtgtcagatgaaagggcgctgaggctcttggccgctgccccgcgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgacctttcagcagatgtccccgtcgcgcaatttcagcttccgcctcttccccgagaccgcgcccggggcccccgggagtatccccgcgccgcccgctcctggcgacgaagcggcggggagcagagtggagcggctgggccaggcgttccggcgacgcgtgcggctgctgcgggagctcagcgagcgcctggagcttgtcttcctggtggatgattcgtccagcgtgggcgaagtcaacttccgcagcgagctcatgttcgtccgcaagctgctgtccgacttccccgtggtgcccacggccacgcgcgtggccatcgtgaccttctcgtccaagaactacgtggtgccgcgcgtcgattacatctccacccgccgcgcgcgccagcacaagtgcgcgctgctcctccaagagatccctgccatctcctaccgaggtggcggcacctacaccaagggcgccttccagcaagccgcgcaaattcttcttcatgctagagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggtaattaaattctgtggcatcggtagttggcaagactaatctgcaaaataagaataattccagaaaagtgaggcaaactagaaacattaacttctattaatttattcatcaagtattttaggatggctaaataatttgataatgtgctgaaagatcattaaggttatatcaaattttagtaacaaataaattatttaaaattatttgccaggattcttaaaaatgacaaaaactaagaaaactaagtcacatatgctggtaaaattcaaatgttgatgtatcctaaaagagaatagtaataaagtcctaacagcaactttt

SEQ ID NO: 30481 - DNA, 4088 bp, Homo sapiens
ttggaaaaccagctagtattaaaggagttgaccaccgaggtaggagttgtgacattttcctgtaaagaagggcatgtcctgcaaggcccctctgtcctgaaatgcttgccatcccagcaatggaatgactctttccctgtttgtaagattgttctttgtaccccacctcccctaatttcctttggtgtccccattccttcttctgctcttcattttggaagtactgtcaagtattcttgtgtaggtgggtttttcctaagaggaaattctaccaccctctgccaacctgatggcacctggagctctccactgccagaatgtgttccagtagaatgtccccaacctgaggaaatccccaatggaatcattgatgtgcaaggccttgcctatctcagcacagctctctatacctgcaagccaggctttgaattggtgggaaatactaccaccctttgtggagaaaatggtcactggcttggaggaaaaccaacatgtaaagccattgagtgcctgaaacccaaggagattttgaatggcaaattctcttacacggacctacactatggacagaccgttacctactcttgcaaccgaggctttcggctcgaaggtcccagtgccttgacctgtttagagacaggtgattgggatgtagatgccccatcttgcaatgccatccactgtgattccccacaacccattgaaaatggttttgtagaaggtgcagattacagctatggtgccataatcatctacagttgcttccctgggtttcaggtggctggtcatgccatgcagacctgtgaagagtcaggatggtcaagttccatcccaacatgtatgccaatagactgtggcctccctcctcatatagattttggagactgtactaaactcaaagatgaccagggatattttgagcaagaagacgacatgatggaagttccatatgtgactcctcaccctccttatcatttgggagcagtggctaaaacctgggaaaatacaaaggagtctcctgctacacattcatcaaactttctgtatggtaccatggtttcatacacctgtaatccaggatatgaacttctggggaaccctgtgctgatctgccaggaagatggaacttggaatggcagtgcaccatcctgcatttcaattgaatgtgacttgcctactgctcctgaaaatggctttttgcgttttacagagactagcatgggaagtgctgtgcagtatagctgtaaacctggacacattctagcaggctctgacttaaggctttgtctagagaatagaaagtggagtggtgcctccccacgctgtgaagccatttcatgcaaaaagccaaatccagtcatgaatggatccatcaaaggaagcaactacacatacctgagcacgttgtactatgagtgtgaccccggatatgtgctgaatggcactgagaggagaacatgccaggatgacaaaactgggatgaggatgagcccatttgcattcctgtggactgcagttcacccccagtctcagccaatggccaggtgagaggagacgagtacacattccaaaaagagattgaatacacttgcaatgaagggttcttgcttgagggagccaggagtcgggtttgtcttgccaatggaagttggagtggagccactcccgactgtgtgcctgtcagatgtgccaccccgccacaactggccaatggggtgacggaaggcctggactatggcttcatgaaggaagtaacattccactgtcacgagggctacatcttgcacggtgctccaaaactcacctgtcagtcagatggcaactgggatgcagagattcctctctgtaaaccagtcaactgtggacctcctgaagatcttgcccatggtttccctaatggtttttcctttattcatgggggccatatacagtatcagtgctttcctggttataagctccatggaaattcatcaagaaggtgcctctccaatggctcctggagtggcagctcaccttcctgcctgccttgcagatgttccacaccagtaattgaatatggaactgtcaatgggacagattttgactgtggaaaggcagcccggattcagtgcttcaaaggcttcaagctcctaggactttctgaaatcacctgtgaagccgatggccagtggagctctgggttcccccactgtgaacacacttcttgtggttctcttccaatgataccaaatgcgttcatcagtgagaccagctcttggaaggaaaatgtgataacttacagctgcaggtctggatatgtcatacaaggcagttcagatctgatttgtacagagaaaggggtatggagccagccttatccagtctgtgagcccttgtcctgtgggtccccaccgtctgtcgccaatgcagtggcaactggagaggcacacacctatgaaagtgaagtgaaactcagatgtctggaaggttatacgatggatacagatacagatacattcacctgtcagaaagatggtcgctggttccctgagagaatctcctgcagtcctaaaaaatgtcctctcccggaaaacataacacatatacttgtacatggggacgatttcagtgtgaataggcaagtttctgtgtcatgtgcagaagggtatacctttgagggagttaacatatcagtatgtcagcttgatggaacctgggagccaccattctccgatgaatcttgcagtccagtttcttgtgggaaacctgaaagtccagaacatggatttgtggttggcagtaaatacacctttgaaagcacaattatttatcagtgtgagcctggctatgaactagaggggaacagggaacgtgtctgccaggagaacagacagtggagtggaggggtggcaatatgcaaagagaccaggtgtgaaactccacttgaatttctcaatgggaaagctgacattgaaaacaggacgactggacccaacgtggtatattcctgcaacagaggctacagtcttgaagggccatctgaggcacactgcacagaaaatggaacctggagccacccagtccctctctgcaaaccaaatccatgccctgttccttttgtgattcccgagaatgctctgctgtctgaaaaggagttttatgttgatcagaatgtgtccatcaaatgtagggaaggttttctgctgcagggccacggcatcattacctgcaaccccgacgagacgtggacacagacaagcgccaaatgtgaaaaaatctcatgtggtccaccagctcacgtagaaaatgcaattgctcgaggcgtacattatcaatatggagacatgatcacctactcatgttacagtggatacatgttggagggtttcctgaggagtgtttgtttagaaaatggaacatggacatcacctcctatttgcagagctgtctgtcgatttccatgtcagaatgggggcatctgccaacgcccaaatgcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctctaccctcacaaaatgtacatattctgctgtctattgggaaagttcctggtacacatttttattcagttacttaaaatgatttttccattaaagtatattttgctact

SEQ ID NO: 30482 - DNA, 12194 bp, Homo sapiens
ccctccggagttcccgagctgctgaggagtctggattgtgtctgtccccagtgtcagatgaaagggcgctgaggctcttggccgctgccccgcgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgacctttcagcagatgtccccgtcgcgcaatttcagcttccgcctcttccccgagaccgcgcccggggcccccgggagtatccccgcgccgcccgctcctggcgacgaagcggcggggagcagagtggagcggctgggccaggcgttccggcgacgcgtgcggctgctgcgggagctcagcgagcgcctggagcttgtcttcctggtggatgattcgtccagcgtgggcgaagtcaacttccgcagcgagctcatgttcgtccgcaagctgctgtccgacttccccgtggtgcccacggccacgcgcgtggccatcgtgaccttctcgtccaagaactacgtggtgccgcgcgtcgattacatctccacccgccgcgcgcgccagcacaagtgcgcgctgctcctccaagagatccctgccatctcctaccgaggtggcggcacctacaccaagggcgccttccagcaagccgcgcaaattcttcttcatgctagagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggaccaggtggctggggtgcagctaataggctggattactcttacgatgacttcctggacactgtgcaagaaacagccacaagcatcggcaatgccaagtcctcacggattaaaagaagtgccccattatctgactataaaattaagttaatttttaacatcacagctagtgtgccattacccgatgaaagaaatgatacccttgaatgggaaaatcagcaacgactccttcagacattggaaactatcacaaataaactgaaaaggactctcaacaaagaccccatgtattcctttcagcttgcatcagaaatacttatagccgacagcaattcattagaaacaaaaaaggcttcccccttctgcagaccaggctcagtgctgagagggcgtatgtgtgtcaattgccctttgggaacctattataatctggaacatttcacctgtgaaagctgccggatcggatcctatcaagatgaagaagggcaacttgagtgcaagctttgcccctctgggatgtacacggaatatatccattcaagaaacatctctgattgtaaagctcagtgtaaacaaggcacctactcatacagtggacttgagacttgtgaatcgtgtccactgggcacttatcagccaaaatttggttcccggagctgcctctcgtgtccagaaaacacctcaactgtgaaaagaggagccgtgaacatttctgcatgtggagttccttgtccagaaggaaaattctcgcgttctgggttaatgccctgtcacccatgtcctcgtgactattaccaacctaatgcagggaaggccttctgcctggcctgtcccttttatggaactaccccattcgctggttccagatccatcacagaatgttcaagttttagttcaactttctcagcggcagaggaaagtgtggtgccccctgcctctcttggacatattaaaaagaggcatgaaatcagcagtcaggttttccatgaatgcttctttaacccttgccacaatagtggaacctgccagcaacttgggcgtggttatgtttgtctctgtccacttggatatacaggcttaaagtgtgaaacagacatcgatgagtgcagcccactgccttgcctcaacaatggagtttgtaaagacctagttggggaattcatttgtgagtgcccatcaggttacacaggtcagcggtgtgaagaaaatataaatgagtgtagctccagtccttgtttaaataaaggaatctgtgttgatggtgtggctggctatcgttgcacatgtgtgaaaggatttgtaggcctgcattgtgaaacagaagtcaatgaatgccagtcaaacccatgcttaaataatgcagtctgtgaagaccaggttgggggattcttgtgcaaatgcccacctggatttttgggtacccgatgtggaaagaacgtcgatgagtgtctcagtcagccatgcaaaaatggagctacctgtaaagacggtgccaatagcttcagatgcctgtgtgcagctggcttcacaggatcacactgtgaattgaacatcaatgaatgtcagtctaatccatgtagaaatcaggccacctgtgtggatgaattaaattcatacagttgtaaatgtcagccaggattttcaggcaaaaggtgtgaaacagaacagtctacaggctttaacctggattttgaagtttctggcatctatggatatgtcatgctagatggcatgctcccatctctccatgctctaacctgtaccttctggatgaaatcctctgacgacatgaactatggaacaccaatctcctatgcagttgataacggcagcgacaataccttgctcctgactgattataacggctgggttctttatgtgaatggcagggaaaagataacaaactgtccctcggtgaatgatggcagatggcatcatattgcaatcacttggacaagtgccaatggcatctggaaagtctatatcgatgggaaattatctgacggtggtgctggcctctctgttggtttgcccatacctggtggtggtgcgttagttctggggcaagagcaagacaaaaaaggagagggattcagcccagctgagtcttttgtgggctccataagccagctcaacctctgggactatgtcctgtctccacagcaggtgaagtcactggctacctcctgcccagaggaactcagtaaaggaaacgtgttagcatggcctgatttcttgtcaggaattgtggggaaagtgaagatcgattctaagagcatattttgttctgattgcccacgcttaggagggtcagtgcctcatctgagaactgcatctgaagatttaaagccaggttccaaagtcaatctgttctgtgatccaggcttccagctggtcgggaaccctgtgcagtactgtctgaatcaaggacagtggacacaaccacttcctcactgtgaacgcattagctgtggggtgccacctcctttggagaatggcttccattcagccgatgacttctatgctggcagcacagtaacctaccagtgcaacaatggctactatctattgggtgactcaaggatgttctgtacagataatgggagctggaacggcgtttcaccatcctgccttgatgtcgatgagtgtgcagttggatcagattgtagtgagcatgcttcttgcctgaacgtagatggatcctacatatgttcatgtgtcccaccgtacacaggagatgggaaaaactgtgcagaacctataaaatgtaaggctccaggaaatccggaaaatggccactcctcaggtgagatttatacagtaggtgccgaagtcacattttcgtgtcaggaaggataccagttgatgggagtaaccaaaatcacatgtttggagtctggagaatggaatcatctaataccatattgtaaagctgtttcatgtggtaaaccggctattccagaaaatggttgcattgaggagttagcatttacttttggcagcaaagtgacatataggtgtaataaaggatatactctggccggtgataaagaatcatcctgtcttgctaacagttcttggagtcattcccctcctgtgtgtgaaccagtgaagtgttctagtccggaaaatataaataatggaaaatatattttgagtgggcttacctacctttctactgcatcatattcatgcgatacaggatacagcttacagggcccttccattattgaatgcacggcttctggcatctgggacagagcgccacctgcctgtcacctcgtcttctgtggagaaccacctgccatcaaagatgctgtcattacggggaataacttcactttcaggaacaccgtcacttacacttgcaaagaaggctatactcttgctggtcttgacaccattgaatgcctggccgacggcaagtggagtagaagtgaccagcagtgcctggctgtctcctgtgatgagccacccattgtggaccacgcctctccagagactgcccatcggctctttggagacattgcattctactactgctctgatggttacagcctagcagacaattcccagcttctctgcaatgcccagggcaagtgggtacccccagaaggtcaagacatgccccgttgtatagctcatttctgtgaaaaacctccatcggtttcctatagcatcttggaatctgtgagcaaagcaaaatttgcagctggctcagttgtgagctttaaatgcatggaaggctttgtactgaacacctcagcaaagattgaatgtatgagaggtgggcagtggaacccttcccccatgtccatccagtgcatccctgtgcggtgtggagagccaccaagcatcatgaatggctatgcaagtggatcaaactacagttttggagccatggtggcttacagctgcaacaaggggttctacatcaaaggggaaaagaagagcacctgcgaagccacagggcagtggagtagtcctataccgacgtgccacccggtatcttgtggtgaaccacctaaggttgagaatggctttctggagcatacaactggcaggatctttgagagtgaagtgaggtatcagtgtaacccgggctataagtcagtcggaagtcctgtatttgtctgccaagccaatcgccactggcacagtgaatcccctctgatgtgtgttcctctcgactgtggaaaacctcccccgatccagaatggcttcatgaaaggagaaaactttgaagtagggtccaaggttcagtttttctgtaatgagggttatgagcttgttggtgacagttcttggacatgtcagaaatctggcaaatggaataagaagtcaaatccaaagtgcatgcctgccaagtgcccagagccgcccctcttggaaaaccagctagtattaaaggagttgaccaccgaggtaggagttgtgacattttcctgtaaagaagggcatgtcctgcaaggcccctctgtcctgaaatgcttgccatcccagcaatggaatgactctttccctgtttgtaagattgttctttgtaccccacctcccctaatttcctttggtgtccccattccttcttctgctcttcattttggaagtactgtcaagtattcttgtgtaggtgggtttttcctaagaggaaattctaccaccctctgccaacctgatggcacctggagctctccactgccagaatgtgttccagtagaatgtccccaacctgaggaaatccccaatggaatcattgatgtgcaaggccttgcctatctcagcacagctctctatacctgcaagccaggctttgaattggtgggaaatactaccaccctttgtggagaaaatggtcactggcttggaggaaaaccaacatgtaaagccattgagtgcctgaaacccaaggagattttgaatggcaaattctcttacacggacctacactatggacagaccgttacctactcttgcaaccgaggctttcggctcgaaggtcccagtgccttgacctgtttagagacaggtgattgggatgtagatgccccatcttgcaatgccatccactgtgattccccacaacccattgaaaatggttttgtagaaggtgcagattacagctatggtgccataatcatctacagttgcttccctgggtttcaggtggctggtcatgccatgcagacctgtgaagagtcaggatggtcaagttccatcccaacatgtatgccaatagactgtggcctccctcctcatatagattttggagactgtactaaactcaaagatgaccagggatattttgagcaagaagacgacatgatggaagttccatatgtgactcctcaccctccttatcatttgggagcagtggctaaaacctgggaaaatacaaaggagtctcctgctacacattcatcaaactttctgtatggtaccatggtttcatacacctgtaatccaggatatgaacttctggggaaccctgtgctgatctgccaggaagatggaacttggaatggcagtgcaccatcctgcatttcaattgaatgtgacttgcctactgctcctgaaaatggctttttgcgttttacagagactagcatgggaagtgctgtgcagtatagctgtaaacctggacacattctagcaggctctgacttaaggctttgtctagagaatagaaagtggagtggtgcctccccacgctgtgaagccatttcatgcaaaaagccaaatccagtcatgaatggatccatcaaaggaagcaactacacatacctgagcacgttgtactatgagtgtgaccccggatatgtgctgaatggcactgagaggagaacatgccaggatgacaaaaactgggatgaggatgagcccatttgcattcctgtggactgcagttcacccccagtctcagccaatggccaggtgagaggagacgagtacacattccaaaaagagattgaatacacttgcaatgaagggttcttgcttgagggagccaggagtcgggtttgtcttgccaatggaagttggagtggagccactcccgactgtgtgcctgtcagatgtgccaccccgccacaactggccaatggggtgacggaaggcctggactatggcttcatgaaggaagtaacattccactgtcacgagggctacatcttgcacggtgctccaaaactcacctgtcagtcagatggcaactgggatgcagagattcctctctgtaaaccagtcaactgtggacctcctgaagatcttgcccatggtttccctaatggtttttcctttattcatgggggccatatacagtatcagtgctttcctggttataagctccatggaaattcatcaagaaggtgcctctccaatggctcctggagtggcagctcaccttcctgcctgccttgcagatgttccacaccagtaattgaatatggaactgtcaatgggacagattttgactgtggaaaggcagcccggattcagtgcttcaaaggcttcaagctcctaggactttctgaaatcacctgtgaagccgatggccagtggagctctgggttcccccactgtgaacacacttcttgtggttctcttccaatgataccaaatgcgttcatcagtgagaccagctcttggaaggaaaatgtgataacttacagctgcaggtctggatatgtcatacaaggcagttcagatctgatttgtacagagaaaggggtatggagccagccttatccagtctgtgagcccttgtcctgtgggtccccaccgtctgtcgccaatgcagtggcaactggagaggcacacacctatgaaagtgaagtgaaactcagatgtctggaaggttatacgatggatacagatacagatacattcacctgtcagaaagatggtcgctggttccctgagagaatctcctgcagtcctaaaaaatgtcctctcccggaaaacataacacatatacttgtacatggggacgatttcagtgtgaataggcaagtttctgtgtcatgtgcagaagggtatacctttgagggagttaacatatcagtatgtcagcttgatggaacctgggagccaccattctccgatgaatcttgcagtccagtttcttgtgggaaacctgaaagtccagaacatggatttgtggttggcagtaaatacacctttgaaagcacaattatttatcagtgtgagcctggctatgaactagaggggaacagggaacgtgtctgccaggagaacagacagtggagtggaggggtggcaatatgcaaagagaccaggtgtgaaactccacttgaatttctcaatgggaaagctgacattgaaaacaggacgactggacccaacgtggtatattcctgcaacagaggctacagtcttgaagggccatctgaggcacactgcacagaaaatggaacctggagccacccagtccctctctgcaaaccaaatccatgccctgttccttttgtgattcccgagaatgctctgctgtctgaaaaggagttttatgttgatcagaatgtgtccatcaaatgtagggaaggttttctgctgcagggccacggcatcattacctgcaaccccgacgagacgtggacacagacaagcgccaaatgtgaaaaaatctcatgtggtccaccagctcacgtagaaaatgcaattgctcgaggcgtacattatcaatatggagacatgatcacctactcatgttacagtggatacatgttggagggtttcctgaggagtgtttgtttagaaaatggaacatggacatcacctcctatttgcagagctgtctgtcgatttccatgtcagaatgggggcatctgccaacgcccaaatgcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctctaccctcacaaaatgtacatattctgctgtctattgggaaagttcctggtacacatttttattcagttacttaaaatgatttttccattaaagtatattttgctactaaataatattttgctggatagtaccattttatgaggtggccaagggattcatagagaggactcatgatctttcatctgtgccactggcaccacataggagaccccttacaataaaggagacccctttgttctggttccatcttctatacaatatgtgtaataataaaagctttttctttcatttaatcaatcagagagtaactgttggacctggtactctccaccacataattatgtcctggtacttagggtagcctggctaattcttttcacaacatttgaaaagccgtaggcattaacttcatggatgtggagaaacagcataatgaccttggttcacaatgaaagtgctagccttctttctcgtggctggaataagaaatgcaagaactggaagattaacaaagagctgatacccggactggtaatcccacaactcactattttgggaggaaggggaagacagggaaagagaaggaaaaaggcaaatgggaaacattccccagagctgtgctcctggtctcacctgcaaaaaagaattgcagccacctaagagaaagctgagctgcccctcagtcctcactgtcacctacctctatcacaacaattgtaccaagatgaagccttccccagacttcagaaaataaagtcaaaccctagattttgttttaaaataggaaactcagaatcaacttgcctccatcctctgggaaaactgctcccacacaggccttggagtgtgttgtagcactgtggaggaatgcagaaaggatgaaagagatcttgattctcctagtggttctcttcactaccgtaggcatccctcagccattgactcctccttctttctcttgacattcactttcttggccagtcttacatgcttatgagtctactttccaataaatttactcatagtccattaa

SEQ ID NO: 30483 - DNA, 12341 bp, Homo sapiens
agggagagaaggagggaagcgggagatttttcttgactgccccctttccttcaaacattttataggcttcagggagagagaggaggaggagagagggaagaaaaaaagaggagagcgagaggggtagagagcgcgcgccgttccctccggagttcccgagctgctgaggagtctggattgtgtctgtccccagtgtcagatgaaagggcgctgaggctcttggccgctgccccgcgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgacctttcagcagatgtccccgtcgcgcaatttcagcttccgcctcttccccgagaccgcgcccggggcccccgggagtatccccgcgccgcccgctcctggcgacgaagcggcggggagcagagtggagcggctgggccaggcgttccggcgacgcgtgcggctgctgcgggagctcagcgagcgcctggagcttgtcttcctggtggatgattcgtccagcgtgggcgaagtcaacttccgcagcgagctcatgttcgtccgcaagctgctgtccgacttccccgtggtgcccacggccacgcgcgtggccatcgtgaccttctcgtccaagaactacgtggtgccgcgcgtcgattacatctccacccgccgcgcgcgccagcacaagtgcgcgctgctcctccaagagatccctgccatctcctaccgaggtggcggcacctacaccaagggcgccttccagcaagccgcgcaaattcttcttcatgctagagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggaccaggtggctggggtgcagctaataggctggattactcttacgatgacttcctggacactgtgcaagaaacagccacaagcatcggcaatgccaagtcctcacggattaaaagaagtgccccattatctgactataaaattaagttaatttttaacatcacagctagtgtgccattacccgatgaaagaaatgatacccttgaatgggaaaatcagcaacgactccttcagacattggaaactatcacaaataaactgaaaaggactctcaacaaagaccccatgtattcctttcagcttgcatcagaaatacttatagccgacagcaattcattagaaacaaaaaaggcttcccccttctgcagaccaggctcagtgctgagagggcgtatgtgtgtcaattgccctttgggaacctattataatctggaacatttcacctgtgaaagctgccggatcggatcctatcaagatgaagaagggcaacttgagtgcaagctttgcccctctgggatgtacacggaatatatccattcaagaaacatctctgattgtaaagctcagtgtaaacaaggcacctactcatacagtggacttgagacttgtgaatcgtgtccactgggcacttatcagccaaaatttggttcccggagctgcctctcgtgtccagaaaacacctcaactgtgaaaagaggagccgtgaacatttctgcatgtggagttccttgtccagaaggaaaattctcgcgttctgggttaatgccctgtcacccatgtcctcgtgactattaccaacctaatgcagggaaggccttctgcctggcctgtcccttttatggaactaccccattcgctggttccagatccatcacagaatgttcaagttttagttcaactttctcagcggcagaggaaagtgtggtgccccctgcctctcttggacatattaaaaagaggcatgaaatcagcagtcaggttttccatgaatgcttctttaacccttgccacaatagtggaacctgccagcaacttgggcgtggttatgtttgtctctgtccacttggatatacaggcttaaagtgtgaaacagacatcgatgagtgcagcccactgccttgcctcaacaatggagtttgtaaagacctagttggggaattcatttgtgagtgcccatcaggttacacaggtcagcggtgtgaagaaaatataaatgagtgtagctccagtccttgtttaaataaaggaatctgtgttgatggtgtggctggctatcgttgcacatgtgtgaaaggatttgtaggcctgcattgtgaaacagaagtcaatgaatgccagtcaaacccatgcttaaataatgcagtctgtgaagaccaggttgggggattcttgtgcaaatgcccacctggatttttgggtacccgatgtggaaagaacgtcgatgagtgtctcagtcagccatgcaaaaatggagctacctgtaaagacggtgccaatagcttcagatgcctgtgtgcagctggcttcacaggatcacactgtgaattgaacatcaatgaatgtcagtctaatccatgtagaaatcaggccacctgtgtggatgaattaaattcatacagttgtaaatgtcagccaggattttcaggcaaaaggtgtgaaacagaacagtctacaggctttaacctggattttgaagtttctggcatctatggatatgtcatgctagatggcatgctcccatctctccatgctctaacctgtaccttctggatgaaatcctctgacgacatgaactatggaacaccaatctcctatgcagttgataacggcagcgacaataccttgctcctgactgattataacggctgggttctttatgtgaatggcagggaaaagataacaaactgtccctcggtgaatgatggcagatggcatcatattgcaatcacttggacaagtgccaatggcatctggaaagtctatatcgatgggaaattatctgacggtggtgctggcctctctgttggtttgcccatacctggtggtggtgcgttagttctggggcaagagcaagacaaaaaaggagagggattcagcccagctgagtcttttgtgggctccataagccagctcaacctctgggactatgtcctgtctccacagcaggtgaagtcactggctacctcctgcccagaggaactcagtaaaggaaacgtgttagcatggcctgatttcttgtcaggaattgtggggaaagtgaagatcgattctaagagcatattttgttctgattgcccacgcttaggagggtcagtgcctcatctgagaactgcatctgaagatttaaagccaggttccaaagtcaatctgttctgtgatccaggcttccagctggtcgggaaccctgtgcagtactgtctgaatcaaggacagtggacacaaccacttcctcactgtgaacgcattagctgtggggtgccacctcctttggagaatggcttccattcagccgatgacttctatgctggcagcacagtaacctaccagtgcaacaatggctactatctattgggtgactcaaggatgttctgtacagataatgggagctggaacggcgtttcaccatcctgccttgatgtcgatgagtgtgcagttggatcagattgtagtgagcatgcttcttgcctgaacgtagatggatcctacatatgttcatgtgtcccaccgtacacaggagatgggaaaaactgtgcagaacctataaaatgtaaggctccaggaaatccggaaaatggccactcctcaggtgagatttatacagtaggtgccgaagtcacattttcgtgtcaggaaggataccagttgatgggagtaaccaaaatcacatgtttggagtctggagaatggaatcatctaataccatattgtaaagctgtttcatgtggtaaaccggctattccagaaaatggttgcattgaggagttagcatttacttttggcagcaaagtgacatataggtgtaataaaggatatactctggccggtgataaagaatcatcctgtcttgctaacagttcttggagtcattcccctcctgtgtgtgaaccagtgaagtgttctagtccggaaaatataaataatggaaaatatattttgagtgggcttacctacctttctactgcatcatattcatgcgatacaggatacagcttacagggcccttccattattgaatgcacggcttctggcatctgggacagagcgccacctgcctgtcacctcgtcttctgtggagaaccacctgccatcaaagatgctgtcattacggggaataacttcactttcaggaacaccgtcacttacacttgcaaagaaggctatactcttgctggtcttgacaccattgaatgcctggccgacggcaagtggagtagaagtgaccagcagtgcctggctgtctcctgtgatgagccacccattgtggaccacgcctctccagagactgcccatcggctctttggagacattgcattctactactgctctgatggttacagcctagcagacaattcccagcttctctgcaatgcccagggcaagtgggtacccccagaaggtcaagacatgccccgttgtatagctcatttctgtgaaaaacctccatcggtttcctatagcatcttggaatctgtgagcaaagcaaaatttgcagctggctcagttgtgagctttaaatgcatggaaggctttgtactgaacacctcagcaaagattgaatgtatgagaggtgggcagtggaacccttcccccatgtccatccagtgcatccctgtgcggtgtggagagccaccaagcatcatgaatggctatgcaagtggatcaaactacagttttggagccatggtggcttacagctgcaacaaggggttctacatcaaaggggaaaagaagagcacctgcgaagccacagggcagtggagtagtcctataccgacgtgccacccggtatcttgtggtgaaccacctaaggttgagaatggctttctggagcatacaactggcaggatctttgagagtgaagtgaggtatcagtgtaacccgggctataagtcagtcggaagtcctgtatttgtctgccaagccaatcgccactggcacagtgaatcccctctgatgtgtgttcctctcgactgtggaaaacctcccccgatccagaatggcttcatgaaaggagaaaactttgaagtagggtccaaggttcagtttttctgtaatgagggttatgagcttgttggtgacagttcttggacatgtcagaaatctggcaaatggaataagaagtcaaatccaaagtgcatgcctgccaagtgcccagagccgcccctcttggaaaaccagctagtattaaaggagttgaccaccgaggtaggagttgtgacattttcctgtaaagaagggcatgtcctgcaaggcccctctgtcctgaaatgcttgccatcccagcaatggaatgactctttccctgtttgtaagattgttctttgtaccccacctcccctaatttcctttggtgtccccattccttcttctgctcttcattttggaagtactgtcaagtattcttgtgtaggtgggtttttcctaagaggaaattctaccaccctctgccaacctgatggcacctggagctctccactgccagaatgtgttccagtagaatgtccccaacctgaggaaatccccaatggaatcattgatgtgcaaggccttgcctatctcagcacagctctctatacctgcaagccaggctttgaattggtgggaaatactaccaccctttgtggagaaaatggtcactggcttggaggaaaaccaacatgtaaagccattgagtgcctgaaacccaaggagattttgaatggcaaattctcttacacggacctacactatggacagaccgttacctactcttgcaaccgaggctttcggctcgaaggtcccagtgccttgacctgtttagagacaggtgattgggatgtagatgccccatcttgcaatgccatccactgtgattccccacaacccattgaaaatggttttgtagaaggtgcagattacagctatggtgccataatcatctacagttgcttccctgggtttcaggtggctggtcatgccatgcagacctgtgaagagtcaggatggtcaagttccatcccaacatgtatgccaatagactgtggcctccctcctcatatagattttggagactgtactaaactcaaagatgaccagggatattttgagcaagaagacgacatgatggaagttccatatgtgactcctcaccctccttatcatttgggagcagtggctaaaacctgggaaaatacaaaggagtctcctgctacacattcatcaaactttctgtatggtaccatggtttcatacacctgtaatccaggatatgaacttctggggaaccctgtgctgatctgccaggaagatggaacttggaatggcagtgcaccatcctgcatttcaattgaatgtgacttgcctactgctcctgaaaatggctttttgcgttttacagagactagcatgggaagtgctgtgcagtatagctgtaaacctggacacattctagcaggctctgacttaaggctttgtctagagaatagaaagtggagtggtgcctccccacgctgtgaagccatttcatgcaaaaagccaaatccagtcatgaatggatccatcaaaggaagcaactacacatacctgagcacgttgtactatgagtgtgaccccggatatgtgctgaatggcactgagaggagaacatgccaggatgacaaaaactgggatgaggatgagcccatttgcattcctgtggactgcagttcacccccagtctcagccaatggccaggtgagaggagacgagtacacattccaaaaagagattgaatacacttgcaatgaagggttcttgcttgagggagccaggagtcgggtttgtcttgccaatggaagttggagtggagccactcccgactgtgtgcctgtcagatgtgccaccccgccacaactggccaatggggtgacggaaggcctggactatggcttcatgaaggaagtaacattccactgtcacgagggctacatcttgcacggtgctccaaaactcacctgtcagtcagatggcaactgggatgcagagattcctctctgtaaaccagtcaactgtggacctcctgaagatcttgcccatggtttccctaatggtttttcctttattcatgggggccatatacagtatcagtgctttcctggttataagctccatggaaattcatcaagaaggtgcctctccaatggctcctggagtggcagctcaccttcctgcctgccttgcagatgttccacaccagtaattgaatatggaactgtcaatgggacagattttgactgtggaaaggcagcccggattcagtgcttcaaaggcttcaagctcctaggactttctgaaatcacctgtgaagccgatggccagtggagctctgggttcccccactgtgaacacacttcttgtggttctcttccaatgataccaaatgcgttcatcagtgagaccagctcttggaaggaaaatgtgataacttacagctgcaggtctggatatgtcatacaaggcagttcagatctgatttgtacagagaaaggggtatggagccagccttatccagtctgtgagcccttgtcctgtgggtccccaccgtctgtcgccaatgcagtggcaactggagaggcacacacctatgaaagtgaagtgaaactcagatgtctggaaggttatacgatggatacagatacagatacattcacctgtcagaaagatggtcgctggttccctgagagaatctcctgcagtcctaaaaaatgtcctctcccggaaaacataacacatatacttgtacatggggacgatttcagtgtgaataggcaagtttctgtgtcatgtgcagaagggtatacctttgagggagttaacatatcagtatgtcagcttgatggaacctgggagccaccattctccgatgaatcttgcagtccagtttcttgtgggaaacctgaaagtccagaacatggatttgtggttggcagtaaatacacctttgaaagcacaattatttatcagtgtgagcctggctatgaactagaggggaacagggaacgtgtctgccaggagaacagacagtggagtggaggggtggcaatatgcaaagagaccaggtgtgaaactccacttgaatttctcaatgggaaagctgacattgaaaacaggacgactggacccaacgtggtatattcctgcaacagaggctacagtcttgaagggccatctgaggcacactgcacagaaaatggaacctggagccacccagtccctctctgcaaaccaaatccatgccctgttccttttgtgattcccgagaatgctctgctgtctgaaaaggagttttatgttgatcagaatgtgtccatcaaatgtagggaaggttttctgctgcagggccacggcatcattacctgcaaccccgacgagacgtggacacagacaagcgccaaatgtgaaaaaatctcatgtggtccaccagctcacgtagaaaatgcaattgctcgaggcgtacattatcaatatggagacatgatcacctactcatgttacagtggatacatgttggagggtttcctgaggagtgtttgtttagaaaatggaacatggacatcacctcctatttgcagagctgtctgtcgatttccatgtcagaatgggggcatctgccaacgcccaaatgcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctctaccctcacaaaatgtacatattctgctgtctattgggaaagttcctggtacacatttttattcagttacttaaaatgatttttccattaaagtatattttgctactaaataatattttgctggatagtaccattttatgaggtggccaagggattcatagagaggactcatgatctttcatctgtgccactggcaccacataggagaccccttacaataaaggagacccctttgttctggttccatcttctatacaatatgtgtaataataaaagctttttctttcatttaatcaatcagagagtaactgttggacctggtactctccaccacataattatgtcctggtacttagggtagcctggctaattcttttcacaacatttgaaaagccgtaggcattaacttcatggatgtggagaaacagcataatgaccttggttcacaatgaaagtgctagccttctttctcgtggctggaataagaaatgcaagaactggaagattaacaaagagctgatacccggactggtaatcccacaactcactattttgggaggaaggggaagacagggaaagagaaggaaaaaggcaaatgggaaacattccccagagctgtgctcctggtctcacctgcaaaaaagaattgcagccacctaagagaaagctgagctgcccctcagtcctcactgtcacctacctctatcacaacaattgtaccaagatgaagccttccccagacttcagaaaataaagtcaaaccctagattttgttttaaaataggaaactcagaatcaacttgcctccatcctctgggaaaactgctcccacacaggccttggagtgtgttgtagcactgtggaggaatgcagaaaggatgaaagagatcttgattctcctagtggttctcttcactaccgtaggcatccctcagccattgactcctccttctttctcttgacattcactttcttggccagtcttacatgcttatgagtctactttccaataaatttactcatagtccattaacttcc

SEQ ID NO: 30484 - DNA, 1725 bp, Homo sapiens
atggactttgacgtcggcagaactacacacctaagttccagtccctgctctgccagtaacgggggtgaatctgggcaagtttctaagcgtcggtgtcttattggagaaagtggacatgataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtggatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcagcaagcacagtgtggccttgatcttcgacacatcaccgtggtggagctggtgggtgtgttcccgactctcattggcaggataggagcaaagattatgcctccagccctagcgctgcagctcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggagc

SEQ ID NO: 30485 - DNA, 1874 bp, Homo sapiens
cccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggatcgggagactcaccactagaagacgatgaagtcgggtattcacaccctagatataaagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtggatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcagcaagcacagtgtggccttgatcttcgacacatcaccgtggtggagctggtgggtgtgttcccgactctcattggcaggataggagcaaagattatgcctccagccctagcgctgcagctcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggagcaaa

SEQ ID NO: 30486 - DNA, 1725 bp, Homo sapiens
agaggcgagaggaggagttttccagcccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggatcgggagactcaccactagaagacgatgaagtcgggtattcacaccctagatataaagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcagcaagcacagtgtggccttgatcttcgacacatcaccgtggtggagctggtgggtgtgttcccgactctcattggcaggataggagcaaagattatgcctccagccctagcgctgcagctcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggagcaaattt

SEQ ID NO: 30487 - DNA, 1780 bp, Homo sapiens
agaggcgagaggaggagttttccagcccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggatcgggagactcaccactagaagacgatgaagtcgggtattcacaccctagatataaagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtggatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggagcaaattt

SEQ ID NO: 30488 - DNA, 1842 bp, Homo sapiens
agaggcgagaggaggagttttccagcccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtggatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcagcaagcacagtgtggccttgatcttcgacacatcaccgtggtggagctggtgggtgtgttcccgactctcattggcaggataggagcaaagattatgcctccagccctagcgctgcagctcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggagcaaattt

SEQ ID NO: 30489 - DNA, 2138 bp, Homo sapiens
agcagacggactgagttcctctaatccctgtgttccttctcccccatctttctaaaacccttctctgagagaggaataactatagcttcagggataatatagctttaaggaaacttttggcagatgtggacgtcgtaacatctgggcagtgttaacagaatcccggaggccgggacagaccaggagccactcgttctaggaatgttaaagtagaaggttttttccaattgatgagaggagcagagaggaaggagaaagaggaggagagagaaaaagggcacaaaataccataaaacagatcccatatttctgcttcccctcacttttagaagttaattgatggctgacttctgaaagtcactttcctttgccctggtacttcaggccatatacatcttttcttgtctccataatcctccctttcaaggatggccagtcagctaactcaaagaggagctctctttctgctgttcttcctaactccggcagtgacaccaacatggtatgcaggttctggctactatccggatgaaagctacaatgaagtatatgcagaggaggtcccacaggctcctgccctggactaccgagtcccccgatggtgttatacattaaatatccaggatggagaagccacatgctactcaccgaagggaggaaattatcacagcagcctgggcacgcgttgtgagctctcctgtgaccggggctttcgattgattggaaggaggtcggtgcaatgcctgccaagccgtcgttggtctggaactgcctactgcaggcagatgagatgccacgcactaccattcatcactagtggcacttacacctgcacaaatggagtgcttcttgactctcgctgtgactacagctgttccagtggctaccacctggaaggtgatcgcagccgaatctgcatggaagatgggagatggagtggaggcgagcctgtatgtgtagacatagatccccccaagatccgctgtccccactcacgtgagaagatggcagagccagagaaattgactgctcgagtatactgggacccaccgttggtgaaagattctgctgatggtaccatcaccagggtgacacttcggggccctgagcctggctctcactttcccgaaggagagcatgtgattcgttacactgcctatgaccgagcctacaaccgggccagctgcaagttcattgtgaaagtacaagtgagacgctgcccaactctgaaacctccgcagcacggctacctcacctgcacctcagcgggggacaactatggtgccacctgtgaataccactgtgatggcggttatgatcgccaggggacaccctcccgggtctgtcagtccagccgccagtggtcaggttcaccaccaatctgtgctcctatgaagattaacgtcaacgtcaactcagctgctggtctcttggatcaattctatgagaaacagcgactcctcatcatctcagctcctgatccttccaaccgatattataaaatgcagatctctatgctacagcaatccacctgtggactggatttgcggcatgtgaccatcattgaactggtgggacagccacctcaggaggtggggcgcatccgggagcaacagctgtcagccaacatcatcgaggagctcaggcaatttcagcgcctcactcgctcctacttcaacatggtgttgattgacaagcagggtattgaccgagaccgctacatggaacctgtcacccccgaggaaatcttcacattcattgatgactacctactgagcaatcaggagttgacccagcgtcgggagcaaagggacatatgcgagtgaacttgagccagggcatggttaaagtcaagggaaaagctcctctagttagctgaaactgggacctaataaaaggaggaaatgttttcccacagttctagggacaggactctgaggtgggtgagtttgacaaatcctgcggtgtttccaggcatccttttaggactgtgtaatagtttccctagaagctaggtagggactgaggacaggccttgggcagtgggttgggggtagaagttcttcctttcctaacccgggcccctgcccagctctccaaagtctttcagaaaagtaaatcctaaattcagtgatgaa

SEQ ID NO: 30490 - DNA, 3104 bp, Homo sapiens
atactttcatggtggaagatgcagtggaagccattggctttggaaaatttcagtggaagctgtctgttctcactggcttggcttggatggctgatgccatggagatgatgatcctcagcatcctggcaccacagctgcattgcgagtggaggctcccaagctggcaggtggcattgctgacctcggtggtctttgtaggcatgatgtccagctccacgctctggggaaatatctcagaccagtacggcaggaaaacagggctgaagatcagcgtgctgtggactctgtactatggcatccttagtgcatttgcgcccgtgtatagctggatcctggtgctccggggcctggtgggcttcgggatcggaggagttccccagtcggtgacgctgtatgccgagttccttcccatgaaagccagagctaaatgtattttgctgattgaggtattctgggccatcgggacagtgttcgaggtcgtcctggctgtgttcgtgatgcccagcctgggctggcgttggctgctcatcctctcagctgtcccgctcctcctctttgccgtgctgtgtttctggctgcctgaaagtgcaaggtatgatgtgctgtcagggaaccaggaaaaggcaatcgccaccttaaagaggatagcaactgaaaacggagctcccatgccgctggggaaactcatcatctccagacaggaagaccgaggcaaaatgagggaccttttcacaccccattttagatggacaactttgctgctgtggtttatatggttttccaatgcattctcttactacgggttagttctactcaccacagaactcttccaggcaggagatgtctgcggcatctccagtcggaagaaggctgtagaggcaaaatgcagcctggcctgcgagtacctgagtgaggaggattacatggacttgctgtggaccaccctctctgagtttccaggtgtccttgtgactctgtggattattgaccgcctggggcgcaagaagaccatggccctgtgctttgtcatcttctccttctgcagcctcctgctgtttatctgtgttggaagaaatgtgctcactctgttactcttcattgcaagagcgtttatttctggaggctttcaagcggcatatgtttacacacctgaggtctaccccacggcaacgcgggccctcggcctgggcacctgcagcggcatggcaagagtgggtgctctcatcactccgttcatcgcccaggtgatgctggaatcctctgtgtacctgactctggcagtttacagtggctgctgcctcctggctgccctggcctcctgctttttgcccattgagaccaaaggccgaggactgcaggagtccagccaccgggagtggggccaggagatggtcggccgaggaatgcacggtgcaggtgttaccaggtcgaactctggctctcaggaatagtgaccgatgggggactgagctggtctttgaggctgcagagcttggggggctggcaggccccaactggggcactgattgtcactgccgacatcaagaactcacccaagagtatgacctggaccaacagggttttgtgtcttgactcagtttgctcatcttcattgaggtccacccagggatggggagatgtttgctctagggggttctctgtatatgtggtgaaagctttgttcataacctgtggatctacatgggaagactacccatattaggagggtctggtaatgccagcaaccaatcagacaccacccagagtcacccggccaaaccctcagtgaacaaccaaaatatctctctgtagataccgtccaggctcaggcccatgtgacacctgctgtccacccaccggacctgttcagtaggtttctcccacactcacagccccaggctttcttctttgaaattgcaggcgatctaggtgtggtctgagcagctatttcctggcaggggccccccggtttgcctccctagagcctgaccagtggattctctggcagatggacatggtgcattcaaactggagccacatgcccccacccagccccctctggagttgccgttgttggcaccaagagatccagatgtgtccctggggacagctggtcttgcaccaggtgacaacctcagaacgccgttaccccctgggaactgaggactgaggccaaagtgaatcaagctgaagtcagagcacgggcctccccttctgaagcagcgaaggccacggttccgacttctttcctggccccctccttggtcaggctgaatggtgacttttattgttttttgagacggagtcttgatctgtcgcccaggctggagtgcagtagcgtgatctcggctcactgcaactctgcctcccgggttcaagcaattctcctgtctcagcctcccgagtagctgggattacaggtgcccacctgtactttttagtagagacagggtttcaccatgttggccaggctggtctcgaactcctgacctcaagtgatccacccgcctcggcctcccacagtgctgagattacaggtgggagccactgcacccggcctgaatgatgactcttgaggggaaaaagtttactcaggtttgcaggtacaaaatccaaaatccagggctttgggttttgtgcatgggtagacagctgaatgggcagagaaaccagaaggatgctacacccaccatctcatcccatggggatcaggggaccaggattccctgatgcgaagctgctcctctgtccagggacgtcttgatcattacacaaaggcagcccctggagttccattcatggagcctgccgtggagtggagaggggtgggaggactcaggtgtgtgaaatgtatatgttttcaaaggaagcagtgggaggccagttggttttgagttggtctccgcaggcaacatcacttctgggatttggtttactggagccttttttcccatggtgaaggcaggggacatagacaaggagggaggaagctggcagatcccatcaaaggccagagcagacagacctactgcttgaagtaaacattgcaaggaagccaatttgtgcgttcaactcttattaaaacatgtcagtgatggacattg

SEQ ID NO: 30491 - DNA, 407 bp, Homo sapiens
aaagggtgctcactggtacccggacaaccatttcacagactggtgtgccctataggcatcccagtgatacaccatcagccagagagcctgtgaactcttccaagcagaagggctctccctgccccctctccccgcgcagctcgctctgccctccgcctcctcttctccgcccactctcgccgcggtctcctggcggcggaggctttgtctcgtgggctggtccccagcggctccctccccgaacagctgctgctccagggaggaagcggcgcgggtgctgtccagcttcccggtgctgaaaaccggagggctcgtcatccaccactaccatgtaagggccatgagaagggctcatcctggcgcagcgcggacatggaggaggacttattccagctaaggcagctgcc

SEQ ID NO: 30492 - DNA, 1413 bp, Homo sapiens
cttgcagatggtgttttttggctacatggttttcagtatcctctttggcctcctggctgacagatatggccgctggaaggttaatcataaagactgaatttttgcccacgaaataccgaggctatatgttacccttgtctcaggtgttctggcttgcgggctccctgctcatcattggcttggcctctgtgatcatccccaccatcgggtggcgctggctcattcgcgtcgcctccatcccgggcatcatcctcatcgtggccttcaagtttattcctgaatctgcccggttcaatgtctccactgggaacactcgggctgccctggccactctggagcgcgttgccaagatgaaccgctcggtcatgccggaggggaagctggtggagcccgtcctggaaaaaagaggaagatttgcagacctattggatgctaaatatttacggaccacattacagatctgggtcatatggcttggaatctcttttgcctactatggggttatcctggccagtgctgagctgctggagcgggacttggtctgtggttcaaagtcagactctgcggtggtggtgactgggggggactcaggggagagccagagcccctgctactgccacatgtttgcaccctctgactatcggaccatgatcatcagcaccatcggtgaaattgctttgaatcctttaaatatactgggcatcaatttcctgggaagacggctgagcctttctattaccatgggatgcacggctttattcttccttctcctcaacatttgcacttcaagtgccggcctgattggcttcctcttcatgctgagggctctggtagctgcaaacttcaacaccgtctacatttacacagctgaggtctaccccaccacgatgcgcgctttggggatgggaaccagcggctccctgtgtcgcattggtgcaatggtggcaccatttatatcccaggttcttatgagtgcatcaatactgggggccctgtgtctcttctcatctgtctgtgttgtatgcgccatttctgcattcactctccccatcgaaaccaaaggacgggccctccagcaaattaaatgaagacctgcaaagctatgtctaccagatgagaaaaatgaattctatcttcagaactgcggtgcatttttttaaaacttggttttacttctgtatgctactcggtaattagtaaagtgattttttttttaaaggcatatatgggaatggggtaggtaactgtatattgatctcttccttgaggaacaatatataaagtacttttataaaatataatttaagctttcaaaggggtgtgagagggagatggtgggggggaagatggcttttcttcattgaaatcaagtctgtaaacctttatatgaataaatactaaattttaaactta

SEQ ID NO: 30493 - DNA, 1489 bp, Homo sapiens
atggcaaccaagccaacagagcctgtcacgatcctcagccttcggaaattgagcctggggaccgcagagccacaggttaaagagccaaagacgttcaccgtggaagatgcagtggagactatcggcttcgggcgtttccacattgccctctttctgatcatgggcagtactggggtggttgaggccatggagatcatgttgatagctgttgtgtctcctgtcatccgctgtgaatggcaactggagaattggcaggtggcattagtaaccacgatggtgttttttggctacatggttttcagtatcctctttggcctcctggctgacagatatggccgctggaagattctgctcatctcgttcctgtggggagcctatttctccttgctgacctcgtttgctccttcgtacatctggtttgtcttcctgcggacgatggtgggctgtggtgtgtccggccactcgcaagggttaatcataaagactgaatttttgcccacgaaataccgaggctatatgttacccttgtctcaggtgttctggcttgcgggctccctgctcatcattggcttggcctctgtgatcatccccaccatcgggtggcgctggctcattcgcgtcgcctccatcccgggcatcatcctcatcgtggccttcaagtttattcctgaatctgcccggttcaatgtctccactgggaacactcgggctgccctggccactctggagcgcgttgccaagatgaaccgctcggtcatgccggaggggaagctggtggagcccgtcctggaaaaaagaggaagatttgcagacctattggatgctaaatatttacggaccacattacagatctgggtcatatggcttggaatctcttttgcctactatggggttatcctggccagtgctgagctgctggagcgggacttggtctgtggttcaaagtcagactctgcggtggtggtgactgggggggactcaggggagagccagagcccctgctactgccacatgtttgcaccctctgactatcggaccatgatcatcagcaccatcggtgaaattgctttgaatcctttaaatatactgggcatcaatttcctgggaagacggctgagcctttctattaccatgggatgcacggctttattcttccttctcctcaacatttgcacttcaagtgccggcctgattggcttcctcttcatgctgagggctctggtagctgcaaacttcaacaccgtctacatttacacagctgaggtctaccccaccacgatgcgcgctttggggatgggaaccagcggctccctgtgtcgcattggtgcaatggtggcaccatttatatcccaggttcttatgagtgcatcaatactgggggccctgtgtctcttctcatctgtctgtgttgtatgcgccatttctgcattcactctccccatcgaaaccaaaggacgggccctccagcaaattaaatgaagacctgcaa

SEQ ID NO: 30494 - DNA, 1421 bp, Homo sapiens
caggacgtcttccagatggtgttttttggctacatggttttcagtatcctctttggcctcctggctgacagatatggccgctggaaggttaatcataaagactgaatttttgcccacgaaataccgaggctatatgttacccttgtctcaggtgttctggcttgcgggctccctgctcatcattggcttggcctctgtgatcatccccaccatcgggtggcgctggctcattcgcgtcgcctccatcccgggcatcatcctcatcgtggccttcaagtttattcctgaatctgcccggttcaatgtctccactgggaacactcgggctgccctggccactctggagcgcgttgccaagatgaaccgctcggtcatgccggaggggaagctggtggagcccgtcctggaaaaaagaggaagatttgcagacctattggatgctaaatatttacggaccacattacagatctgggtcatatggcttggaatctcttttgcctactatggggttatcctggccagtgctgagctgctggagcgggacttggtctgtggttcaaagtcagactctgcggtggtggtgactgggggggactcaggggagagccagagcccctgctactgccacatgtttgcaccctctgactatcggaccatgatcatcagcaccatcggtgaaattgctttgaatcctttaaatatactgggcatcaatttcctgggaagacggctgagcctttctattaccatgggatgcacggctttattcttccttctcctcaacatttgcacttcaagtgccggcctgattggcttcctcttcatgctgagggctctggtagctgcaaacttcaacaccgtctacatttacacagctgaggtctaccccaccacgatgcgcgctttggggatgggaaccagcggctccctgtgtcgcattggtgcaatggtggcaccatttatatcccaggttcttatgagtgcatcaatactgggggccctgtgtctcttctcatctgtctgtgttgtatgcgccatttctgcattcactctccccatcgaaaccaaaggacgggccctccagcaaattaaatgaagacctgcaaagctatgtctaccagatgagaaaaatgaattctatcttcagaactgcggtgcatttttttaaaacttggttttacttctgtatgctactcggtaattagtaaagtgattttttttttaaaggcatatatgggaatggggtaggtaactgtatattgatctcttccttgaggaacaatatataaagtacttttataaaatataatttaagctttcaaaggggtgtgagagggagatggtgggggggaagatggcttttcttcattgaaatcaagtctgtaaacctttatatgaataaatactaaattttaaactta

SEQ ID NO: 30495 - DNA, 4882 bp, Homo sapiens
aggtgactgcgcggcgggctgtggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaaggtccaagacaactttgacaagattgaattcaataggatgtgttggaccctctgtgtcaaaaaaaacctcacaaagaatcccctgctcattacagaagaagatgcatttaaaatatgggttattttcaactttttatctgaggacaagtatccattaattattgtgtcagaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaacgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggagcagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagagcagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagaccaacgagacttaggtaaggaatggaacctttcctgtggtttgactgcacattacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 30496 - DNA, 4048 bp, Homo sapiens
gcggagtgattccccacccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatggtaaaattttcagcattttcctaacttttagatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaattt

SEQ ID NO: 30497 - DNA, 4099 bp, Homo sapiens
gagcgaaggggttggaagcggagtgattccccacccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggataaattcctagaagtggaatttctgggtcaaagggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatggtaaaattttcagcattttcctaacttttagatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaat

SEQ ID NO: 30498 - DNA, 3995 bp, Homo sapiens
gagcgaaggggttggaagcggagtgattccccacccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatggtaaaattttcagcattttcctaacttttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaat

SEQ ID NO: 30499 - DNA, 3090 bp, Homo sapiens
agtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggataaattcctagaagtggaatttctgggtcaaagggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaa

SEQ ID NO: 30500 - DNA, 2239 bp, Homo sapiens
acttcattaaatctagaggcagttgagcatgggagccgtctgtatgttgaattagggctcgcactcttgcgcaacacgtcaccagtcggaaactgggggtttgcttctgtgatttatttcattattgtgctggtaaaaggtttggaagggaattctttttgggggtagtactttagcattgtgtagcaagttttggggttttttttgtgtgtgaccccccagcccccagcgctgagtttgagtcagttgagccagtttagtaaataattttttaaaataaaagaacagtttaaaatctccatgaataattttacttacatgcaggagtaatcttactctactctttatgtgcgaaaagcattgggaagtgtttagtgaattgatttccattagaaaaagacccttagaaatcacagaacataaagcactgcatatggatgtgtttggggtctttggggaggagggaagatgttttgtagctctctgcattcctgcataaaaccttagtttgaggggaataatgctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgac

SEQ ID NO: 30501 - DNA, 1118 bp, Homo sapiens
acttcattaaatctagaggcagttgagcatgggagccgtctgtatgttgaattagggctcgcactcttgcgcaacacgtcaccagtcggaaactgggggtttgcttctgtgatttatttcattattgtgctgctgatgaagagactagcagctcgctgctttgctggcttgttaattttatccccactaactgtgatttctgatagccggcctgctgatagtggtaagtgctgctggctctggtttaaagcaagcgtttgcaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctat

SEQ ID NO: 30502 - DNA, 5757 bp, Homo sapiens
tttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaa

SEQ ID NO: 30503 - DNA, 5703 bp, Homo sapiens
tttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaa

SEQ ID NO: 30504 - DNA, 1347 bp, Homo sapiens
ggccgccctcccgctgagaaactgtcaccaaatccccccaaactgacaaagcagatgaacgctatcatcgatactgtgataaactacaaagataggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaa

SEQ ID NO: 30505 - DNA, 1121 bp, Homo sapiens
ctcgcactcttgcgcaacacgtcaccagtcggaaactgggggtttgcttctgtgatttatttcattattgtgctggtaaaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaattt

SEQ ID NO: 30506 - DNA, 1787 bp, Homo sapiens
agggctcgcactcttgcgcaacacgtcaccagtcggaaactgggggtttgcttctgtgatttatttcattattgtgctggtaaaagctgatgaagagactagcagctcgctgctttgctggcttgttaattttatccccactaactgtgatttctgatagccggcctgctgatagtggtaagtgctgctggctctggtttaaagcaagcgtttgcaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttc

SEQ ID NO: 30507 - DNA, 947 bp, Homo sapiens
agcatgggagccgtctgtatgttgaattagggctcgcactcttgcgcaacacgtcaccagtcggaaactgggggtttgcttctgtgatttatttcattattgtgctgtgctgctggctctggtttaaagcaagcgtttgcaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacct

SEQ ID NO: 30508 - DNA, 5561 bp, Homo sapiens
gtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaa

SEQ ID NO: 30509 - DNA, 5867 bp, Homo sapiens
tcagaagaaagccccgagatcacagagacccggcgagatcacagagacccggcctgaaggaacgtggaaagaccaatgtacctgttttgaccggttgcctggagcaagaagttccagttggggagaattttcagaagataaagtcggagattgtggaaagacttgacttgcagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaa

SEQ ID NO: 30510 - DNA, 587 bp, Homo sapiens
agtagaactacatcccaggcatgtgtaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgagg

SEQ ID NO: 30511 - DNA, 921 bp, Homo sapiens
tgggagccgtctgtatgttgaattagggctcgcactcttgcgcaacacgtcaccagtcggaaactgggggtttgcttctgtgatttatttcattattgtgctgctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgtaagtgtagccgactggga

SEQ ID NO: 30512 - DNA, 594 bp, Homo sapiens
aaatctagaggcagttgagcatgggagccgtctgtatgttgaattagggctcgcactcttgcgcaacacgtcaccagtcggaaactgggggtttgcttctgtgatttatttcattattgtgctggtaaaagctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctgg

SEQ ID NO: 30513 - DNA, 564 bp, Homo sapiens
gcagcggctcgggcagctgctcctgcccgcaccctcccctggagcccggggaggacaaggcgagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggc

SEQ ID NO: 30514 - DNA, 1744 bp, Homo sapiens
agattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagagg

SEQ ID NO: 30515 - DNA, 750 bp, Homo sapiens
cttggagaggcggaggtggaaacgatgcgcaggagttggcttggggctttttgtttgcgtgtccctgtttacctattcataatcatggatcccctctgctttgtgatactgtgaaccacgcataacagcaattctttacaccaccgggttgagaagaaggcgcctgaggctgactttctggacctgccgtcacgcagtaaagatgtggttggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgc

SEQ ID NO: 30516 - DNA, 356 bp, Homo sapiens
tttccggtacacgcggggaaatcgcctcctgccagtgtctgatcgctcgcctccgcctccgcctctgccgcctggattgcattattatttttatccgggttgccgtttgctgcggatggtgcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccac

SEQ ID NO: 30517 - DNA, 5392 bp, Homo sapiens
gtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaa

SEQ ID NO: 30518 - DNA, 5790 bp, Homo sapiens
ggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaaaattacaggaaaagatatccatgacacagccagcagtgtggcacgtgggctacaattccagcgtggccttcagttctgcacacgtgcgtcaaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagcc

SEQ ID NO: 30519 - DNA, 4854 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 30520 - DNA, 5796 bp, Homo sapiens
ggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatgggacagagggaaaagagcaggcgcgggcttgggagtcagtcctgggctcggatatttgctgatctctctgatcatcagaatgactgtgtgacctcagtgactgagtcgctggttgggcagatattggcagcgtgttctggtgaggagggggaagtggagtggaaggggagggacagggtaagaaggcttcgggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagcc

SEQ ID NO: 30521 - DNA, 5770 bp, Homo sapiens
ggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcgtctcgcccttttgcccaggctagagtgcagtggtgcggtcatggttcactgcagcctcaacctcctggactcagcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagcc

SEQ ID NO: 30522 - DNA, 4842 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 30523 - DNA, 4851 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 30524 - DNA, 4845 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 30525 - DNA, 7923 bp, Homo sapiens
gcgagtgttgaaagtcggtggcgtaggtcgtcgtcctggatgctggcgagatagatgttatcttccagaggaagaggaggaggcggcgaagcgttttcccagcctcagtctctctttcgttttccttttcccttcccccaaccctccgcccttctctaaatcagccggccttccttgacctcagtgacccgtctggccccgcccaccctcgtcgacgtgattcccgccgtgaggtaagcgccggtggaacctagagccccgcggaagagcagaacgtttgggagtgtgcagctcctgggcccggctcaggcccgtcgcggaggcgcggcgcaggggagcgctcgggtgggagtctcgctcctccaccagtttattgcgacgtagcatccaggcctaggcctccccgtccatccccgccggactcgggcctctggcagcagcgggtgacgcagacggaacatcatgtcgtccgcggccgagcctccgccacccccgcctcccgagagcgcgccttccaagcccgcagcctcgatcgccagcggcgggagcaacagcagcaacaaaggcggccccgaaggcgtcgcggcgcaggcggttgcgtctgcggccagcgctggtcccgcagacgccgagatggaggaaatatttgatgatgcgtcacctggaaagcaaaaggaaatccaagaaccagatcctacctatgaagaaaaaatgcaaactgaccgggcaaatagattcgagtatttattaaagcagacagaactttttgcacatttcattcaacctgctgctcagaagactccaacttcacctttgaagatgaaaccagggcgcccacgaataaaaaaagatgagaagcagaacttactatccgttggcgattaccgacaccgtagaacagagcaagaggaggatgaagagctattaacagaaagctccaaagcaaccaatgtttgcactcgatttgaagactctccatcgtatgtaaaatggggtaaactgagagattatcaggtccgaggattaaactggctcatttctttgtatgagaatggcatcaatggtatccttgcagatgaaatgggcctaggaaagactcttcaaacaatttctcttcttgggtacatgaaacattatagaaacattcctgggcctcatatggttttggttcctaagtctacattacacaactggatgagtgaattcaagagatgggtaccaacacttagatctgtttgtttgataggagataaagaacaaagagctgcttttgtcagagacgttttattaccgggagaatgggatgtatgtgtaacatcttatgaaatgcttattaaagagaagtctgtgttcaaaaaatttaattggagatacttagtaatagatgaagctcacaggatcaaaaatgaaaaatctaagttgtcagaaatagtgagggaattcaagactacaaatagactattattaactggaacacctcttcagaacaacttgcatgagctgtggtcacttcttaactttctgttgccagatgtgtttaattcagcagatgactttgattcctggtttgatacaaacaactgccttggggatcaaaaactagttgagaggcttcatatggttttgcgtccattcctccttcgtcgaattaaggctgatgttgaaaagagtttgcctccaaagaaggaagtaaaaatctatgtgggcctcagcaaaatgcaaagggaatggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggttcacgagtactaatcttcagtcaaatgacaagggtattggacattttggaagattattgcatgtggagaaattatgagtactgcaggttggatggtcagacaccccatgatgagagacaagactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggattcaatagtcattcaacaagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaagactgcagagatgaatgaaaagctctccaagatgggcgaaagttcacttagaaactttacaatggatacagagtcaagtgtttataacttcgaaggagaagactatagagaaaaacaaaagattgcattcacagagtggattgaaccacctaaacgagaaagaaaagccaactatgccgttgatgcatatttcagggaagctcttcgtgttagtgaacctaaagcacccaaggctcctcgacctccaaaacaacccaatgttcaggatttccagttctttcctccacgtttatttgaattactggaaaaagaaattctgttttacagaaaaactattgggtacaaggtacctcgaaatcctgagctgcctaatgcagcacaggcacaaaaagaagaacagcttaaaattgatgaagctgaatcccttaatgatgaagagttagaggaaaaagagaagcttctaacacagggatttaccaattggaataagagagattttaaccagtttatcaaagctaatgagaagtggggtcgtgatgatattgaaaatatagcaagagaagtagaaggcaaaactccagaagaagtcattgaatattcagctgtgttttgggaaaggtgcaacgagctccaggacatagagaagattatggctcagattgaaaggggagaggcgagaattcaaagaagaataagcatcaagaaagcacttgacacaaagattggacggtacaaagcaccttttcatcagctgagaatatcatatggtactaacaaaggaaaaaactatactgaagaagaagatcgttttctgatttgtatgcttcacaaacttggatttgacaaagaaaatgtttatgatgaattgcgacagtgtattcgcaactctcctcagttcagatttgactggtttcttaagtccagaactgcaatggagctccagaggagatgtaataccttaattactttgattgaaagagaaaacatggaactagaagaaaaggagaaggcagagaaaaagaaacgaggaccaaagccttcaacacagaaacgtaaaatggatggcgcacctgatggtcgaggaagaaaaaagaagctgaaactatgaatatgtttttgtttcataatcactaactttaaaccagtagttctttaatttacgggtcttcataagatgtactgtacaatgctcaattgttatgtcatttaaagacatcaggttcatctgtttactgagctagaaacatagtatgtagtttcacttttttaaatgcaacagctgtgctgaaatttttttatcattaacacttgaagtaataaaataggcttcatttattactaagtgtttcatttgatttatttttctattgtagttccatttgtgaagattgtgactttttgtttattagctataatttctacacttgtaaggcttaaaaacaagttaaaaagaaaattgcaaataacatttgtccctttcagtcttcacctagttgtgtaattattttaattcactttgcctttgcagaaatttgggtattttctttgtagtgctattgagtctcatctggaaagattatataaattgcattctccttgcttatgtgggtagaatgggaaaagaaggcaagacaaagtatacttaaattctatgcatatttctgttatgctttctgttttttttagttgattctgaaatgaatatgccctattcttttgaaagaatggccttttagttgtatagccaaagacatttagtattttccggttccttaaggtattactgtaccattttgtaaaaggaatattattattattatttttaattatttggtaaatattttgtcatatgaccttctgaagcagccacaacttagataatgtcagaactaaggtgattttttttttttaattttgaaagcccagccaaaatgaggtgtgaatttgtcatactgttacattgaaattggtaacaaaatatatcccctcccatttggacttttagggtaaatgaaaattttattgtattttaaagtagtttctaagtgttagcaagactgactataattccagtttctgttttctatggacagacctgataaactggagaccctaaagcaggaatacccaaattatagtgtcaggattttagctgtaccagaggcctttatgtgctacacataatttgtataaaattttatatgtgcagattgggtacataaacagttctccatttttctaagggaatgcaataaatgtagcatcgtgaataaatataacttttataatccgtaaagtggtcttttctttccatttctttaattgttttctcaatttttattcactttttcctttaggacacatttcccttaattggatatctttcccttaaatttctattagtagttgttttcatctgcccacatgtaattgaagatttaaaaaaaaaattttgatacctgcagtattactaatactgcttaatttcttgaaatgtggaattgctgctgttaatgtcaagcaaaacgcagtatttatggcaaattgtaaagtaatttgaatttagtgctacctcaaaattaactttttaaatactatgttagattcttaacagttaaaggtctaatacatgcatgaggaatggttacttatgaaaggaaaaagaatttgtaagagttatcacctcagtttggaagaaattgaaaaaatgtaaggctgaagaaaacttacggaggtcacaaaagtgatgttttcaagaggaggagaaactgggagggagatacacagtggaaatgcaaaatgaatcaagtatagtggtagccctgagagcttagggactcaaatggaaactgtgtgaagggaaactcacttgaaaaaaaagcatgaaccagctaggccctgccaccactgtgtttggccaagttcacaaatctgttttaacctgtcacttccctgtcacttctctggctttcctctcccgctaagcttttgtttcctggcagtaattaaaatcttctgtcagtgccacagctactactgctactggaactgccttaaccactactgctactggaactgccttagccaccttggtatcgtggtttggcaaagtattggcctctaccaccatagggcccagagcttctgcctccaaagtttcctcccttcatgggtccaaaatttgaagactgattgttgtcattgccaaaatcattgtagcttttaccacctccaaaattgcttcaatcattaccaaatctattatagcaatccccactgccaccatatccatcaccaccaccatggctgccaccaaagccaccacgatcacagaacttgatgactgtatttgtgactaattgtataatagtttctgttctgtggaaagtaaagcattccaacacagggtttcagtgtagattgttttgttttgtacccatgctgttgattgctaaatgttttaataatctgatcatgatactgaataaatgtctttttttttttttaacaacaaagcatgaaagattgcttaattgtacatctgacaaagtgctggaggctattataaagtgtaattattactacttttaagagacagggtcttgctctgtcacccaggctggagtgcagtggtgcaatcacagctcactgcaacctcaaacttcagggctcaagtgatcctcccacctcagcttcccaagtagctaggactacagataccacgcccagctaagtttttttagtttttgtagagatagggccttgctatgttgcccagtccggtctcaaacgccgacttcaggcaatcctcttgcgtcaacctctcaaagtgctgggattacatgtgtaagcctacattccaaagtgctgggatcatagttgtgagcctacaccacacctggcctacattttgtttttcataaagttgagagaagcaaatcctaagcatagagtacaagttgagcatccctaatcaaaaaatctaaaatcagaaatgctccataatttgaatgctcattagggcatttctgatttttggattagggatgctgaactgataagtataatgcaagtattctaaagtctggaaaatgctaaaaacacttctggttccaggcatttcagataaggattgctccatctgccctttgagtatttaatatatgccgattgtttgaactaatctggatttaattatataaatgattatataaatgatctttggcttagtacctttcttaatctcgatcttaaaaagcattgtaaaacacccctgtggtttttcagaaaaattctgagtaaaaaataaatttcatcttgttctatccctttgaatctaaaaaacaaatctttttgaaaggatgtgctactatatttcaaaccagtagttttggagtagaacattgctaaaaaaatgggtactaaggagggtaatttaaacaaagtagattaatgacacaaggtggattgatgaactcataaatccaaatgaatggaatgctagaagacatgtattaacggagtagctgttaccaaaatatatacatattttgtatatgtacatagctgttaccaaaatgtatctttgcctgttggaatctgatgtcaagatcaaaggtgagggcatccctcagatgacagataatgggcaaaatacattcttggtgtggagcagtgctgcagaattaacttcgctgtgtacatcccagaatcgttttggatctgttaaggtttttattagaatgattaaataggcttttgcagcattaactttacagtagttaccagaaaagactatgctacaagaaccaaaattgaagtaagaagaaaaagactgaaatgatatgattctaaatgaaaaaaatgaagaagtggaatagtttctccacaggcataagaggcaaagcattgtttcagaagtggactggcacctcacctgagatactcaagactggcaacatgggtctacattctttgttaccacagattcccttgtgtccggagagattccctagctctaatgacagcttttttggggggtaatgaggctatgagaagattgaggatctaggtacttgcctttaactctacagcatacaaggtgtgtggctcttatctctaggacaccaatatttaatgttgcatatcatgtatctccagtacaagaagaaagtttatcagaatttagttaatgttggaaactttgtaatataaacaatgtaaacactacattgacaaaaatattttattaatacaaagaatatgcatatagtttgcttactacagaaattcttgtttttgatgtagacaacccaaaggagtttttatgtatatagattgtgaataaattgggaaaagaaatagagataagtagagattatttcacttcattaaacttttgaagtcctaa

SEQ ID NO: 30526 - DNA, 3475 bp, Homo sapiens
gtgttgaaagtcggtggcgtaggtcgtcgtcctggatgctggcgagatagatgttatcttccagaggaagaggaggaggcggcgaagcgttttcccagcctcagtctctctttcgttttccttttcccttcccccgagcctccgccacccccgcctcccgagagccggcgggagcaacagcagcaacaaaggcggccccgaaggcgtcgcggcgcaggcggttgcgtctgcggccagcgctggtcccgcagacgccgagatggaggaaatatttgatgatgcgtcacctggaaagcaaaaggaaatccaagaaccagatcctacctatgaagaaaaaatgcaaactgaccgggcaaatagattcgagtatttattaaagcagacagaactttttgcacatttcattcaacctgctgctcagaagactccaacttcacctttgaagatgaaaccagggcgcccacgaataaaaaaagatgagaagcagaacttactatccgttggcgattaccgacaccgtagaacagagcaagaggaggatgaagagctattaacagaaagctccaaagcaaccaatgtttgcactcgatttgaagactctccatcgtatgtaaaatggggtaaactgagagattatcaggtccgaggattaaactggctcatttctttgtatgagaatggcatcaatggtatccttgcagatgaaatgggcctaggaaagactcttcaaacaatttctcttcttgggtacatgaaacattatagaaacattcctgggcctcatatggttttggttcctaagtctacattacacaactggatgagtgaattcaagagatgggtaccaacacttagatctgtttgtttgataggagataaagaacaaagagctgcttttgtcagagacgttttattaccgggagaatgggatgtatgtgtaacatcttatgaaatgcttattaaagagaagtctgtgttcaaaaaatttaattggagatacttagtaatagatgaagctcacaggatcaaaaatgaaaaatctaagttgtcagaaatagtgagggaattcaagactacaaatagactattattaactggaacacctcttcagaacaacttgcatgagctgtggtcacttcttaactttctgttgccagatgtgtttaattcagcagatgactttgattcctggtttgatacaaacaactgccttggggatcaaaaactagttgagaggcttcatatggttttgcgtccattcctccttcgtcgaattaaggctgatgttgaaaagagtttgcctccaaagaaggaagtaaaaatctatgtgggcctcagcaaaatgcaaagggaatggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggttcacgagtactaatcttcagtcaaatgacaagggtattggacattttggaagattattgcatgtggagaaattatgagtactgcaggttggatggtcagacaccccatgatgagagacaagactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggattcaatagtcattcaacaagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaagactgcagagatgaatgaaaagctctccaagatgggcgaaagttcacttagaaactttacaatggatacagagtcaagtgtttataacttcgaaggagaagactatagagaaaaacaaaagattgcattcacagagtggattgaaccacctaaacgagaaagaaaagccaactatgccgttgatgcatatttcagggaagctcttcgtgttagtgaacctaaagcacccaaggctcctcgacctccaaaacaacccaatgttcaggatttccagttctttcctccacgtttatttgaattactggaaaaagaaattctgttttacagaaaaactattgggtacaaggtacctcgaaatcctgagctgcctaatgcagcacaggcacaaaaagaagaacagcttaaaattgatgaagctgaatcccttaatgatgaagagttagaggaaaaagagaagcttctaacacagggatttaccaattggaataagagagattttaaccagtttatcaaagctaatgagaagtggggtcgtgatgatattgaaaatatagcaagagaagtagaaggcaaaactccagaagaagtcattgaatattcagctgtgttttgggaaaggtgcaacgagctccaggacatagagaagattatggctcagattgaaaggggagaggcgagaattcaaagaagaataagcatcaagaaagcacttgacacaaagattggacggtacaaagcaccttttcatcagctgagaatatcatatggtactaacaaaggaaaaaactatactgaagaagaagatcgttttctgatttgtatgcttcacaaacttggatttgacaaagaaaatgtttatgatgaattgcgacagtgtattcgcaactctcctcagttcagatttgactggtttcttaagtccagaactgcaatggagctccagaggagatgtaataccttaattactttgattgaaagagaaaacatggaactagaagaaaaggagaaggcagagaaaaagaaacgaggaccaaagccttcaacacagaaacgtaaaatggatggcgcacctgatggtcgaggaagaaaaaagaagctgaaactatgaatatgtttttgtttcataatcactaactttaaaccagtagttctttaatttacgggtcttcataagatgtactgtacaatgctcaattgttatgtcatttaaagacatcaggttcatctgtttactgagctagaaacatagtatgtagtttcacttttttaaatgcaacagctgtgctgaaatttttttatcattaacacttgaagtaataaaataggcttcatttat

SEQ ID NO: 30527 - DNA, 3557 bp, Homo sapiens
cgagtgttgaaagtcggtggcgtaggtcgtcgtcctggatgctggcgagatagatgttatcttccagaggaagaggaggaggcggcgaagcgttttcccagcctcagtctctctttcgttttccttttcccttcccccaaccctccgcccttctctaaatcagccggccttccttgacctcagtgacccgtctggccccgcccaccctcgtcgacgtgattcccgccgtgaggtaagcgccggtggaacctagagccccgcggaagagcagaacgtttgggagtgtgcagctcctgggcccggctcaggcccgtcgcggaggcgcggcgcaggggagcgctcgggtgggagtctcgctcctccaccagtttattgcgacgtagcatccaggcctaggcctccccgtccatccccgctggtcccgcagacgccgagatggaggaaatatttgatgatgcgtcacctggaaagcaaaaggaaatccaagaaccagatcctacctatgaagaaaaaatgcaaactgaccgggcaaatagattcgagtatttattaaagcagacagaactttttgcacatttcattcaacctgctgctcagaagactccaacttcacctttgaagatgaaaccagggcgcccacgaataaaaaaagatgagaagcagaacttactatccgttggcgattaccgacaccgtagaacagagcaagaggaggatgaagagctattaacagaaagctccaaagcaaccaatgtttgcactcgatttgaagactctccatcgtatgtaaaatggggtaaactgagagattatcaggtccgaggattaaactggctcatttctttgtatgagaatggcatcaatggtatccttgcagatgaaatgggcctaggaaagactcttcaaacaatttctcttcttgggtacatgaaacattatagaaacattcctgggcctcatatggttttggttcctaagtctacattacacaactggatgagtgaattcaagagatgggtaccaacacttagatctgtttgtttgataggagataaagaacaaagagctgcttttgtcagagacgttttattaccgggagaatgggatgtatgtgtaacatcttatgaaatgcttattaaagagaagtctgtgttcaaaaaatttaattggagatacttagtaatagatgaagctcacaggatcaaaaatgaaaaatctaagttgtcagaaatagtgagggaattcaagactacaaatagactattattaactggaacacctcttcagaacaacttgcatgagctgtggtcacttcttaactttctgttgccagatgtgtttaattcagcagatgactttgattcctggtttgatacaaacaactgccttggggatcaaaaactagttgagaggcttcatatggttttgcgtccattcctccttcgtcgaattaaggctgatgttgaaaagagtttgcctccaaagaaggaagtaaaaatctatgtgggcctcagcaaaatgcaaagggaatggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggttcacgagtactaatcttcagtcaaatgacaagggtattggacattttggaagattattgcatgtggagaaattatgagtactgcaggttggatggtcagacaccccatgatgagagacaagactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggattcaatagtcattcaacaagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaagactgcagagatgaatgaaaagctctccaagatgggcgaaagttcacttagaaactttacaatggatacagagtcaagtgtttataacttcgaaggagaagactatagagaaaaacaaaagattgcattcacagagtggattgaaccacctaaacgagaaagaaaagccaactatgccgttgatgcatatttcagggaagctcttcgtgttagtgaacctaaagcacccaaggctcctcgacctccaaaacaacccaatgttcaggatttccagttctttcctccacgtttatttgaattactggaaaaagaaattctgttttacagaaaaactattgggtacaaggtacctcgaaatcctgagctgcctaatgcagcacaggcacaaaaagaagaacagcttaaaattgatgaagctgaatcccttaatgatgaagagttagaggaaaaagagaagcttctaacacagggatttaccaattggaataagagagattttaaccagtttatcaaagctaatgagaagtggggtcgtgatgatattgaaaatatagcaagagaagtagaaggcaaaactccagaagaagtcattgaatattcagctgtgttttgggaaaggtgcaacgagctccaggacatagagaagattatggctcagattgaaaggggagaggcgagaattcaaagaagaataagcatcaagaaagcacttgacacaaagattggacggtacaaagcaccttttcatcagctgagaatatcatatggtactaacaaaggaaaaaactatactgaagaagaagatcgttttctgatttgtatgcttcacaaacttggatttgacaaagaaaatgtttatgatgaattgcgacagtgtattcgcaactctcctcagttcagatttgactggtttcttaagtccagaactgcaatggagctccagaggagatgtaataccttaattactttgattgaaagagaaaacatggaactagaagaaaaggagaaggcagagaaaaagaaacgaggaccaaagccttcaacacagaaacgtaaaatggatggcgcacctgatggtcgaggaagaaaaaagaagctgaaactatgaatatgtttttgtttcataatcactaactttaaaccagtagttctttaatttacgggtcttcataagatgtactgtacaatgctcaattgttatgtcatttaaagacatcaggttcatctgtttactgagctaga

SEQ ID NO: 30528 - DNA, 3271 bp, Homo sapiens
atcattcttacttttggaagcgaaactgcggccgcgttgcctgctgggaaatgtagttcagcggtggcctagcccttcaggcctggccgctacaataaggctggcgaactcgcagcgcttgaatacccgtggcctaaccgtccactcggaagaccggtcccgctcgggaggctctgcagtcgcgcctggggtcagggccgggggcgaatgtggctcgcgttctaggcctccctgggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaaggtcatgctcaggcttcacctgagatcaggttcacaccctttgctaacccaactcataagcctctggccaaaccaaagagttcccaagagacaccagctcattcctctggacagcctcccagggatgctaagttagaggccaagacagcaaaagcctccccttcggggcagaacatttcttacatccattctagctcagagagtgtaacgcccaggacagaaggaagactccagcagaagtcagggtcctcagtccaaaaaggagtgaactctcagaagggaaagtgcgtaaggaacggcgatcgtttccaggtgttgattgggtacaatgcggaactcattgcagtgtttaagaccctgcccagcaagaattatgatcctgacaccaagacgtggaacttcagcatgaatgactatagtgccctgatgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatgatgtcaagaccaggaagtggagctttctcttggaagagcacagtaaactaattgcaaaggtgcgctgcctcccacaagttcagctggaccctctgcccacgactctcaccctggcgtttgcttctcagctcaagaagacatctctcagtctcacgccagatgtcccagaggcagacctttctgaagtggaccccaagctcgtgtctaatctgatgccctttcagagagctggagtcaattttgccatagccaaaggaggccgcctgctgctcgctgacgacatgggcctggggaagaccatccaagccatctgcatcgcagccttttaccggaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgatgaatctcacttcctcaaaaacagtaggactgcccgctgtcgagcagctatgccggtcctaaaggttgccaagagggtgatcctgttgtcgggcacaccagccatgtcccggcccgcagagctctacacgcagatcatcgcagtcaagccaactttcttcccccagtttcatgcctttggacttcgctactgtgatgccaaacggatgccttgggggtgggactactcaggttcctccaacctgggagagctgaagctcctgctggaggaagcagtcatgctgcggcgcctcaagtccgacgtcctttcccagctgcctgccaagcagcgcaagatagtggtgattgccccaggacggatcaatgccaggaccagagctgccctggatgctgcagccaaggaaatgaccaccaaggacaaaactaaacagcagcagaaagatgccctcattctcttcttcaacagaacagctgaagctaaaatcccatctgtcattgaatatatcttggacctactggaaagtggaagagagaagtttttagtatttgcacaccataaggtggtcctggacgcaattacgcaagagcttgagagaaagcacgtgcagcacatccgcatcgatggctccacctcatcagctgagcgggaggacctgtgccagcagttccaactgtcggagaggcatgctgtggccgtgctgtccatcaccgctgccaatatgggcctcaccttctcctcggctgacctggtggtgtttgctgagctgttttggaacccaggggtgctgatccaggctgaggaccgcgtgcaccgcattggacagaccagctccgtgggcattcactacctcgtggcaaagggcacagctgatgactacctttggcccctgattcaagagaagattaaagttctggcagaagccgggctttctgagaccaatttttcagaaatgacagaatccactgattacctctacaaggacccaaagcagcagaagatctacgacctattccagaagtcctttgagaaagaaggaagtgatatggagctcctggaagcagcagagtcctttgacccaggaagtgcttcaggaacatctggaagtagttcccagaacatgggagacaccctggatgaaagctcattgacagccagtccacagaagaaaaggagatttgaattttttgataactgggacagctttacgtctcccctgtaaaaggggcaaaaagaaaaaaataaaaagcattttaaaatcatggaattgaaataaaataatgtattttgttttaaaa

SEQ ID NO: 30529 - DNA, 3056 bp, Homo sapiens
aagtggagatcgtaggggtgggagtggggcgtggcgcccgcttaccttgaggctgggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaaggtcatgctcaggcttcacctgagatcaggttcacaccctttgctaacccaactcataagcctctggccaaaccaaagagttcccaagagacaccagctcattcctctggacagcctcccagggatgctaagttagaggccaagacagcaaaagcctccccttcggggcagaacatttcttacatccattctagctcagagagtgtaacgcccaggacagaaggaagactccagcagaagtcagggtcctcagtccaaaaaggagtgaactctcagaagggaaagtgcgtaaggaacggcgatcgtttccaggtgttgattgggtacaatgcggaactcattgcagtgtttaagaccctgcccagcaagaattatgatcctgacaccaagacgtggaacttcagcatgaatgactatagtgccctgatgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatgatgtcaagaccaggaagtggagctttctcttggaagagcacagtaaactaattgcaaaggtgcgctgcctcccacaagttcagctggaccctctgcccacgactctcaccctggcgtttgcttctcagctcaagaagacatctctcagtctcacgccagatgtcccagaggcagacctttctgaagtggaccccaagctcgtgtctaatctgatgccctttcagagagctggagtcaattttgccatagccaaaggaggccgcctgctgctcgctgacgacatgggcctggggaagaccatccaagccatctgcatcgcagccttttaccggaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgatgaatctcacttcctcaaaaacagtaggactgcccgctgtcgagcagctatgccggtcctaaaggttgccaagagggtgatcctgttgtcgggcacaccagccatgtcccggcccgcagagctctacacgcagatcatcgcagtcaagccaactttcttcccccagtttcatgcctttggacttcgctactgtgatgccaaacggatgccttgggggtgggactactcaggttcctccaacctgggagagctgaagctcctgctggaggaagcagtcatgctgcggcgcctcaagtccgacgtcctttcccagctgcctgccaagcagcgcaagatagtggtgattgccccaggacggatcaatgccaggaccagagctgccctggatgctgcagccaaggaaatgaccaccaaggacaaaactaaacagcagcagaaagatgccctcattctcttcttcaacagaacagctgaagctaaaatcccatctgtcattgaatatatcttggacctactggaaagtggaagagagaagtttttagtatttgcacaccataaggtggtcctggacgcaattacgcaagagcttgagagaaagcacgtgcagcacatccgcatcgatggctccacctcatcagctgagcgggaggacctgtgccagcagttccaactgtcggagaggcatgctgtggccgtgctgtccatcaccgctgccaatatgggcctcaccttctcctcggctgacctggtggtgtttgctgagctgttttggaacccaggggtgctgatccaggctgaggaccgcgtgcaccgcattggacagaccagctccgtgggcattcactacctcgtggcaaagggcacagctgatgactacctttggcccctgattcaagagaagattaaagttctggcagaagccgggctttctgagaccaatttttcagaaatgacagaatccactgattacctctacaaggacccaaagcagcagaagatctacgacctattccagaagtcctttgagaaagaaggaagtgatatggagctcctggaagcagcagagtcctttgacccaggaagtgcttcaggaacatctggaagtagttcccagaacatgggagacaccctggatgaaagctcattgacagccagtccacagaagaaaaggagatttgaattttttgataactgggacagctttacgtctcccctgtaaaaggggcaaaaagaaaaaaataaaaagcattttaaaatca

SEQ ID NO: 30530 - DNA, 310 bp, Homo sapiens
ggaagaccggtcccgctcgggaggctctgcagtcgcgcctggggtcagggccgggggcgaatgtggctcgcgttctaggcctccctgggtgagaaagtggtagactggcaggaaggcggcggaggcggacgagaccaatgccagcctggaggaggaagttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaagg

SEQ ID NO: 30531 - DNA, 722 bp, Homo sapiens
atcattcttacttttggaagcgaaactgcggccgcgttgcctgctgggaaatgtagttcagcggtggcctagcccttcaggcctggccgctacaataaggctggcgaactcgcagcgcttgaatacccgtggcctaaccgtccactcggaagaccggtcccgctcgggaggctctgcagtcgcgcctggggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaagg

SEQ ID NO: 30532 - DNA, 544 bp, Homo sapiens
agtggggcgtggcgcccgcttaccttgaggctgggtgaggctcgccccgaaatgcggggcgtggggggcggggggcagaggtccctgcctagaggggaagaggggcgtccatgtggcggaatggatttatggtttggggctgatcagtgggtcttatggccgagtctctctggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttc

SEQ ID NO: 30533 - DNA, 711 bp, Homo sapiens
aaggctggcgaactcgcagcgcttgaatacccgtggcctaaccgtccactcggaagaccggtcccgctcgggaggctctgcagtcgcgcctggggtcagggccgggggcgaatgtggctcgcgttctaggcctccctgggtgagaaagtggtagactggcaggaaggcggcggaggcggacgagaccaatgccagcctggaggaggaagtgggccaatgggaagggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctc

SEQ ID NO: 30534 - DNA, 6375 bp, Homo sapiens
ggctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattacccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgtttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctggattctagtcccattctctgcattcatacaccagtttcttcatatatcctatgaagaacctaaacatttggccccacctggtcttggtttgatcagcagttaaaattctgtgactcgggcttccttcccgactgcccaccttcatgatgtgtaaggaacatacattttgagggtacctcacccactgttcatttgcatggtcaaagtgaaaatgagtggaagttctccaaaaatgatggccaacatcctggcacctccaggtgtgagaaatagctttgcttggtgaatgggataatgtttgtcaggatgcagtttagacagtcccaagttggaggcaggccttgagggcagaagattctgtgaaccttgggggacagcttttgggtactcacagatataaaccctgtgcagaaaaaaagaagtgattgttttcaggatgcttataaatcgagtgaagcaaaagaagaggattctgtgtctgccatgagatgaacgccctgctcttcacgaaggtgtgcctctaataaagagagccaaagccagctgggtctcaccagattcctatactttctcaaggatgttgggggaggttaatcctttatcgaaactaaagactggtttat

SEQ ID NO: 30535 - DNA, 4076 bp, Homo sapiens
gcggcgggaggcgggcggaggaggaggcggaggaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcgggtaatgctcctttgggtttgccttttggcatgccgcctcctcctcctcctcctgctccatccatcatcccatttggtagtctagctgactccatcagtattaacctccccgctcctcctaacctgcatgggcatcaccaccatctcccgttcgccccgggcactctccccccacctaacctgcctgtgtccatggcgaaccctctacatcctaacctgccggcgaccaccaccatgccatcttccttgcctctcgggccggggctcggatccgccgcagcccaaagccctgccattgtggcagctgttcagggcaacctcctgcccagtgccagcccactgccagacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggatt

SEQ ID NO: 30536 - DNA, 3839 bp, Homo sapiens
gcggcgggaggcgggcggaggaggaggcggaggaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagggccgccaggttgatgctgataccaaggctgggcgaaagggcaaagagctggatgacctggtgccagagacggctaagggcaagccagagctgcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcggacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaa

SEQ ID NO: 30537 - DNA, 4271 bp, Homo sapiens
gcggccgcggcggcgggaggcggcgggaggcgggcggaggaggaggcggaggaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagggccgccaggttgatgctgataccaaggctgggcgaaagggcaaagagctggatgacctggtgccagagacggctaagggcaagccagagctgcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcggcccaaagccctgccattgtggcagctgttcagggcaacctcctgcccagtgccagcccactgccagacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaaaagtagattttaaaaagccacattggagctcccttctacccactaaaaaataaccaatttttacattttttgagggggagtgagttttaggaaaggggaattaagattccagggagagctctggggatagaacagggcgcagattccatctctccccaagcccctttttagtgactaagtcaaggccccaactcccctcccccaccctacgctgagcttattcgagttcattcgtactaataatccctcctgcggcttcctcattgttgctgttttaggccaccccagctcagccaatgattcctttccctctgaatgtcagttttgtttttaaaagtcacttgctt

SEQ ID NO: 30538 - DNA, 3237 bp, Homo sapiens
agcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaa

SEQ ID NO: 30539 - DNA, 3658 bp, Homo sapiens
ttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaaggatgggtcctcctacctactgtgagagagctcttccctgagctcttcttccttcaataccattagccac

SEQ ID NO: 30540 - DNA, 1757 bp, Homo sapiens
tttgtgcggctgcatcggcggctccgggaagatggcggcccgggcgggtttccagtctgtggctccaagcggcggcgccggagcctcaggaggggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagtcagccttgtccaaatatgatgccactaaacaaaagaggaagttctcttccttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttg

SEQ ID NO: 30541 - DNA, 2279 bp, Homo sapiens
atgctgcccggaccggcgctccggggaccgggtccggcgcagtaccagcgacctggcatgtcaccagggaaccggatgcccatggctcttgcaggtgggaccccctgctggctccccatttggtgcagcagctccgcttcgacctggcatgccacccaccatgatggatccattccgaaaacgcctgcttgtgccccacagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcagggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagtcttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacatctggcaggtttggaaatttccaaataaatccttttgtctattg

SEQ ID NO: 30542 - DNA, 1935 bp, Homo sapiens
agtgtgtgcaaggcagagctgccaaacaggccttgcaggcagcagccatggggaggcgggtgggggtggaggtgactcccagatgggctccacagaaatgtcagggagcaaggcctcagcgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcagggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagtcttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctac

SEQ ID NO: 30543 - DNA, 2770 bp, Homo sapiens
gttgggcggggcagggagttcgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggcgtggggggccccggggccgccgccttccgccccatgggccccgcgggccccgcggcgcagtaccagcgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcagggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagtcttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacatctggcaggtttggaaatttccaaataaatccttttgtctattg

SEQ ID NO: 30544 - DNA, 2228 bp, Homo sapiens
cgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgccttccgccccatgggccccgcgggccccgcggcgcagtaccagcgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcagggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagtcttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagcc

SEQ ID NO: 30545 - DNA, 1993 bp, Homo sapiens
cgcgggcctcggcggcttcgggctgcagcactgctgcccagcgcccgcggccgggctggtcggcgcgcctcgccgcttatctgcgctgtttggacagcgggcttggaaaggcaggcggccccgtccccgccgagtcaacaggcagaccccgggccgccggactatttctgtcttatcagtgcaggaatgcggcagccgcggcggcggcggcggcggcgggcgggcggcggcggcgtgggccgtgggccgtcagggcagccctgaaggggccccctccccactccgctcgagtagaagtgtgagagagcccagcaggactcagaggggagagttggaggaaaaaaaaaggcagaaaagggaaagaaagaggaagagagagagagagtgagaggagccgctgagcccaccccgatggccgcggacgaagttgccggaggggcgcgcaaagccacgaaaagcaaactttttgagtttctggtccatggggtgcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 30546 - DNA, 2216 bp, Homo sapiens
actcccaagccccacctctgtcacccacaccccgctcctacagcactgctctcttcttagctcccatgccccaccgtctgctcagggacttcatttcataagttgggtcctgacccaacgagctggaggccttcctgctcttccagcaaggaaggaagcagggcaggacaggacagagcaggcactagcagggaccaggagggaggcgcctaggccagctggtagtcatggagcaggctgactacctgcctgccacctctggagtccctccatgcccctgggctccagggccatcccagttaccatcctgacctgccctctggcctttgcctccaatgcccagctctctccctccaaccattgccacacccccaaaactggcctctccagtcagggcttgggctctgcctggggtccctgctctgtctttcaagttctttgtcccgcaggaccctggggccggtctctgtctgcttcccacacatactgctcccacctgcgccctgccttgtgccaccccagccccagctggcccatgctggttgcctccatcctaggcccttttttctgcacagtgtcctggcttcctcagacctccactccggggagtttggcttcttcgcagcttcccgaggcctccttgaatctacgctggggctcagggtctgacctctcctttcagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctg

SEQ ID NO: 30547 - DNA, 1669 bp, Homo sapiens
ctggcatcttcctcccctcctcctttccagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctg

SEQ ID NO: 30548 - DNA, 2018 bp, Homo sapiens
gtgcgcgcccacgtgcatgcgcgtgtgtggtcctagtgtaggtgatgtctgcggccacacaggatgctgactgcgtgtgtgactcgtgggcgtgcagatgcaagcacaggcctacgacacatctgtgtacaggctgaagatcacaacgggtctggccagggcccgccgagggcctccgagctggcgagcacaccgacggctggatggggcgacgcttcctgctccggtccctaactcattattaagctcctcgctctttgcagacgctccctgcgcctcccccgctccgggctgcagcggcgcaggcgccgggccgagccgagcgccgagcagggagcgggcggccgcgctccgggccggggtcccgggggagcagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 30549 - DNA, 613 bp, Homo sapiens
aaatgcttggcaggctccctgcccgctggctgcttagggaggtgctcccacttcccccgccgttgcctgagctctctagggctccttcactctgcagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaag

SEQ ID NO: 30550 - DNA, 4912 bp, Homo sapiens
gggaacgtgcctgcgcgtgcttggatagttcatttaaagcccccatccctgcaaggtggtgctttctaccaatatgaatcttttcaacctggaccgttttcgctttgagaaaaggaataagattgaggaagcgcccgaagcaacccctcaaccttcccagcctggcccttcttcaccaatttctcttagtgctgaagaggagaatgctgaaggggaagttagcagggcaaacactcctgattcagatataactgaaaaaacagaagattctagtgttccagaaactccagataatgaaagaaaagcaagtatatcatatttcaaaaatcaaagaggaatacagtatattgatttgtcttctgatagtgaagatgtcgtttccccaaattgctccaatacagttcaagagaaaacattcaacaaagatacagtgattatagtttctgagccatctgaagatgaagagtcccaaggccttcctaccatggcacgtagaaatgatgatatttcagaactggaagacctttcggaattggaagaccttaaagatgctaaacttcagactttgaaggaactttttccacaaagaagtgacaatgatttacttaagttgattgaatcaacaagcactatggatggagcaattgctgctgccttgctgatgtttggtgatgcaggtggtgggcccaggaaaagaaaattatcttcttcttcagagccatatgaggaagatgaatttaatgatgatcaatctataaaaaagacaagactggatcatggagaggaatcaaatgagtctgcagaatctagcagtaattgggaaaagcaggaaagtattgtactgaaattgcaaaaggaatttcccaattttgataaacaggaacttagagaagtactcaaggaacatgaatggatgtacacagaagctttagaatctctaaaagtgtttgcagaagaccaagatatgcaatatgtatcacaaagtgaggttccaaatggaaaagaagtttcttcaagaagtcaaaattaccctaaaaatgcaactaaaacaaaactaaaacagaaattttcaatgaaagcacaaaatggctttaacaagaaacgtaaaaaaaatgtttttaatccaaagagagttgttgaagactctgaatatgattcaggttctgatgtcggtagttcactagatgaggactatagtagtggtgaagaagtgatggaggatggctataaaggtaaaattcttcacttccttcaagatgcttcaattggtgaacttactttgattcctcagtgttctcagaaaaaggctcagaagataacagaactccggccctttaatagttgggaggctctgttcacaaagatgtccaaaactaatggcttatcagaagatttgatatggcactgtaaaacactgatccaagaaagagatgtagttataaggcttatgaacaaatgtgaagacatttcaaataaattgaccaaacaagttaccatgcttactggaaatggaggtggatggaacatagaacaaccttccattctaaaccaaagtttgtcactcaagccctatcagaaggttggtttgaattggctggcattggtacataaacatggacttaatggcattttggcagatgaaatgggcctaggaaaaactattcaagccattgcatttctggcatacctctatcaggagggtaataatggtcctcatttgatcgttgttccagcttcaactatagataactggttaagggaagttaatttatggtgccctactttgaaggtcctctgttactatggttctcaagaagaacgtaaacaaattagatttaacattcatagtagatatgaagattacaatgtaattgtgaccacatataactgtgcgatcagcagttctgatgaccgtagtctgtttcgacggctgaaacttaattacgcaatttttgatgagggccatatgctgaagaatatgggctccattcgctaccagcaccttatgacaattaatgcaaataaccgtttgctgctcacaggcacacctgtacagaacaatctgttagaactcatgtcgctgttgaattttgttatgccacacatgtttagtagtagcaccagtgaaatacgaagaatgttttcctctaagacaaaatcagcagatgagcaaagcatatatgaaaaggagagaatagcacatgcaaaacaaattataaagccatttattctcagaagagtaaaagaagaggttctcaagcagttaccccccaagaaagatcgaattgagttgtgtgcaatgtcggagaagcaggagcaactctatttgggtcttttcaacagattgaaaaaatctatcaataacttggaaaaaaacacagaaatgtgcaatgtcatgatgcagttgaggaaaatggccaatcatcctttattacatcgccaatattacacagctgaaaaactcaaggaaatgtctcagcttatgctaaaggaacctacacattgtgaggctaaccctgacctgatctttgaagatatggaagttatgacagacttcgaactacatgtactttgtaaacagtaccgacacattaataactttcagttagacatggacttgattttagattctggaaaatttcgagttttaggatgcatcttgtctgaattgaaacagaagggtgatagagttgtgttatttagccaatttaccatgatgctggatatcttagaggttctattaaaacatcatcagcataggtacctcagattagatggaaagactcagatttctgaaaggattcatctaattgatgagtttaataccgatatggatatctttgtgtttctgctatcaacaaaagctggtggattaggaataaatctgacttcagcaaatgttgttatacttcacgatattgactgtaatccttataatgacaaacaagcagaagatagatgccatagagtaggccagactaaagaagtactagttataaaactaataagccaagggacgattgaagaatccatgctaaaaattaaccaacagaaattgaaactagaacaggatatgactacagtagatgaaggtgatgaagggagtatgccagcagatatagccacattactaaaaacatcaatgggcctgtgaaataagaactgtgaactctcaattgatgaggaaatatcaacttggtgcactcaaggacatttacattatgatgaccatggggtttatgaacatttataactttttataatttccatattacatttctcatagtatggacaactttttgccactaactgaattctccaaatactcacacgtgaaatttcaaaaaagaagccacaaatatgtagttctgaagatgttgaataatcattttacaaagcagttttctgaatggggattagttggtgattgtttgtaacaaatatgctaatgctttagaaatgtcagtatttttgtaattatttctacctccaaatatatatatattgtctttcactggataatgtgtgtagatttttacatgtgccttatttgacaatgcttatgtcttgtttttgcttgtctcatttgaagttcttttttattatgttaaagaatgcagctgtatagattatatagctttcattttattgctatttgaagcagatgttcaccaatgtcagcaagaactcaacctgaatttaaaggtggcattccatatactaacatcccccaggtcctctcaagtacttctgctgaaacaaatttatttggctaggcactaagttgttttccagtgaatagtaactaaagaagcccctaccttgctccatggattaattccttctgttcattttccaactgcactaattgtgcatattactctgcctaatcttgtgcatgttttcattgatttccctctcccggcttttgcttctcttgaaactgttgcccagtcacttctgctccaattctcttcctctctaaatagtagtttattactgccacatctccatgcatcagcaaaatgttggtgacatttttctagcctggcagaacagattacttaaagctatttcatttcaaagcagactgaatgtgacttcatctaaaggcagcattaggtactgcatggaaataggtcattaacttgaaactcttatcaaaatatattttaccagtttccagaatttccagtacaggaccgcctgaagagagagccattgttcaattccaattcagtgtgagtgacaaagtgaaatttagaagtgaagttgtctatttgatatttaactctttattaaatctttctttaaatttctgcctgtcagtctatattgctgtttttattatacatcagtttctttgtataacttgtgagttccatgtgttttgtttttattatgtaaatatcattataaataaacttatttataaatcaaagatttgttaatttttggaaatcatgcttttcaaagcatcctaacttgctaagatgctaggtagtacgaccctctggatttggaaggcaaataaaactcttacagtgattatttagatattaaagactgagaactcacggcttaaccccagtcttgatggtatattgaacagactgaatatattttaccattacagggctaaaaggagtcttcatgtgttaatactacctccttgtacatcactatacccaaatcagttattcaaattgttaggaattttaccttttaaaatctcataatggatatctcatgttttctgtattaatgtattttcaatgataggctgtttctttttttgttgttattgttgttgttgttatatccatacttttatctctaatgaaatgtagttgggttcttcctgtaatgcgctattatgtcttgggcttaataaaaatatttgtgatcataa

SEQ ID NO: 30551 - DNA, 5017 bp, Homo sapiens
attacgcgctcttaaggtttctccgtggtgttttggaaggtcccggcacggctaccgtcgccccacgctaggaaattttttttttattttcaacctttgttacatagcactgaggctacaagatcatagttcatttaaagcccccatccctgcaaggtggtgctttctaccaatatgaatcttttcaacctggaccgttttcgctttgagaaaaggaataagattgaggaagcgcccgaagcaacccctcaaccttcccagcctggcccttcttcaccaatttctcttagtgctgaagaggagaatgctgaaggggaagttagcagggcaaacactcctgattcagatataactgaaaaaacagaagattctagtgttccagaaactccagataatgaaagaaaagcaagtatatcatatttcaaaaatcaaagaggaatacagtatattgatttgtcttctgatagtgaagatgtcgtttccccaaattgctccaatacagttcaagagaaaacattcaacaaagatacagtgattatagtttctgagccatctgaagatgaagagtcccaaggccttcctaccatggcacgtagaaatgatgatatttcagaactggaagacctttcggaattggaagaccttaaagatgctaaacttcagactttgaaggaactttttccacaaagaagtgacaatgatttacttaagttgattgaatcaacaagcactatggatggagcaattgctgctgccttgctgatgtttggtgatgcaggtggtgggcccaggaaaagaaaattatcttcttcttcagagccatatgaggaagatgaatttaatgatgatcaatctataaaaaagacaagactggatcatggagaggaatcaaatgagtctgcagaatctagcagtaattgggaaaagcaggaaagtattgtactgaaattgcaaaaggaatttcccaattttgataaacaggaacttagagaagtactcaaggaacatgaatggatgtacacagaagctttagaatctctaaaagtgtttgcagaagaccaagatatgcaatatgtatcacaaagtgaggttccaaatggaaaagaagtttcttcaagaagtcaaaattaccctaaaaatgcaactaaaacaaaactaaaacagaaattttcaatgaaagcacaaaatggctttaacaagaaacgtaaaaaaaatgtttttaatccaaagagagttgttgaagactctgaatatgattcaggttctgatgtcggtagttcactagatgaggactatagtagtggtgaagaagtgatggaggatggctataaaggtaaaattcttcacttccttcaagatgcttcaattggtgaacttactttgattcctcagtgttctcagaaaaaggctcagaagataacagaactccggccctttaatagttgggaggctctgttcacaaagatgtccaaaactaatggcttatcagaagatttgatatggcactgtaaaacactgatccaagaaagagatgtagttataaggcttatgaacaaatgtgaagacatttcaaataaattgaccaaacaagttaccatgcttactggaaatggaggtggatggaacatagaacaaccttccattctaaaccaaagtttgtcactcaagccctatcagaaggttggtttgaattggctggcattggtacataaacatggacttaatggcattttggcagatgaaatgggcctaggaaaaactattcaagccattgcatttctggcatacctctatcaggagggtaataatggtcctcatttgatcgttgttccagcttcaactatagataactggttaagggaagttaatttatggtgccctactttgaaggtcctctgttactatggttctcaagaagaacgtaaacaaattagatttaacattcatagtagatatgaagattacaatgtaattgtgaccacatataactgtgcgatcagcagttctgatgaccgtagtctgtttcgacggctgaaacttaattacgcaatttttgatgagggccatatgctgaagaatatgggctccattcgctaccagcaccttatgacaattaatgcaaataaccgtttgctgctcacaggcacacctgtacagaacaatctgttagaactcatgtcgctgttgaattttgttatgccacacatgtttagtagtagcaccagtgaaatacgaagaatgttttcctctaagacaaaatcagcagatgagcaaagcatatatgaaaaggagagaatagcacatgcaaaacaaattataaagccatttattctcagaagagtaaaagaagaggttctcaagcagttaccccccaagaaagatcgaattgagttgtgtgcaatgtcggagaagcaggagcaactctatttgggtcttttcaacagattgaaaaaatctatcaataacttggtcacagaaaaaaacacagaaatgtgcaatgtcatgatgcagttgaggaaaatggccaatcatcctttattacatcgccaatattacacagctgaaaaactcaaggaaatgtctcagcttatgctaaaggaacctacacattgtgaggctaaccctgacctgatctttgaagatatggaagttatgacagacttcgaactacatgtactttgtaaacagtaccgacacattaataactttcagttagacatggacttgattttagattctggaaaatttcgagttttaggatgcatcttgtctgaattgaaacagaagggtgatagagttgtgttatttagccaatttaccatgatgctggatatcttagaggttctattaaaacatcatcagcataggtacctcagattagatggaaagactcagatttctgaaaggattcatctaattgatgagtttaataccgatatggatatctttgtgtttctgctatcaacaaaagctggtggattaggaataaatctgacttcagcaaatgttgttatacttcacgatattgactgtaatccttataatgacaaacaagcagaagatagatgccatagagtaggccagactaaagaagtactagttataaaactaataagccaagggacgattgaagaatccatgctaaaaattaaccaacagaaattgaaactagaacaggatatgactacagtagatgaaggtgatgaagggagtatgccagcagatatagccacattactaaaaacatcaatgggcctgtgaaataagaactgtgaactctcaattgatgaggaaatatcaacttggtgcactcaaggacatttacattatgatgaccatggggtttatgaacatttataactttttataatttccatattacatttctcatagtatggacaactttttgccactaactgaattctccaaatactcacacgtgaaatttcaaaaaagaagccacaaatatgtagttctgaagatgttgaataatcattttacaaagcagttttctgaatggggattagttggtgattgtttgtaacaaatatgctaatgctttagaaatgtcagtatttttgtaattatttctacctccaaatatatatatattgtctttcactggataatgtgtgtagatttttacatgtgccttatttgacaatgcttatgtcttgtttttgcttgtctcatttgaagttcttttttattatgttaaagaatgcagctgtatagattatatagctttcattttattgctatttgaagcagatgttcaccaatgtcagcaagaactcaacctgaatttaaaggtggcattccatatactaacatcccccaggtcctctcaagtacttctgctgaaacaaatttatttggctaggcactaagttgttttccagtgaatagtaactaaagaagcccctaccttgctccatggattaattccttctgttcattttccaactgcactaattgtgcatattactctgcctaatcttgtgcatgttttcattgatttccctctcccggcttttgcttctcttgaaactgttgcccagtcacttctgctccaattctcttcctctctaaatagtagtttattactgccacatctccatgcatcagcaaaatgttggtgacatttttctagcctggcagaacagattacttaaagctatttcatttcaaagcagactgaatgtgacttcatctaaaggcagcattaggtactgcatggaaataggtcattaacttgaaactcttatcaaaatatattttaccagtttccagaatttccagtacaggaccgcctgaagagagagccattgttcaattccaattcagtgtgagtgacaaagtgaaatttagaagtgaagttgtctatttgatatttaactctttattaaatctttctttaaatttctgcctgtcagtctatattgctgtttttattatacatcagtttctttgtataacttgtgagttccatgtgttttgtttttattatgtaaatatcattataaataaacttatttataaatcaaagatttgttaatttttggaaatcatgcttttcaaagcatcctaacttgctaagatgctaggtagtacgaccctctggatttggaaggcaaataaaactcttacagtgattatttagatattaaagactgagaactcacggcttaaccccagtcttgatggtatattgaacagactgaatatattttaccattacagggctaaaaggagtcttcatgtgttaatactacctccttgtacatcactatacccaaatcagttattcaaattgttaggaattttaccttttaaaatctcataatggatatctcatgttttctgtattaatgtattttcaatgataggctgtttctttttttgttgttattgttgttgttgttatatccatacttttatctctaatgaaatgtagttgggttcttcctgtaatgcgctattatgtcttgggcttaataaaaatatttgtgatcat

SEQ ID NO: 30552 - DNA, 4649 bp, Homo sapiens
ctctcagctgggatcgcgccgcgtcaacttccgggcggatgcccgccagcacggcctccgccgctccccttctttggcccctttgtgtccccgcagtgtcgaggcgcgggccctggcaggtcctttctcgaggcagggggcacggtagcacagggagcttctctttgtgggcgggcgcgaggcccgctagggggttatactggggaacgtgcctgcgcgtgcttggatagttcatttaaagcccccatccctgcaaggtggtgctttctaccaatatgaatcttttcaacctggaccgttttcgctttgagaaaaggaataagattgaggaagcgcccgaagcaacccctcaaccttcccagcctggcccttcttcaccaatttctcttagtgctgaagaggagaatgctgaaggggaagttagcagggcaaacactcctgattcagatataactgaaaaaacagaagattctagtgttccagaaactccagataatgaaagaaaagcaagtatatcatatttcaaaaatcaaagaggaatacagtatattgatttgtcttctgatagtgaagatgtcgtttccccaaattgctccaatacagttcaagagaaaacattcaacaaagatacagtgattatagtttctgagccatctgaagatgaagagtcccaaggccttcctaccatggcacgtagaaatgatgatatttcagaactggaagacctttcggaattggaagaccttaaagatgctaaacttcagactttgaaggaactttttccacaaagaagtgacaatgatttacttaagttgattgaatcaacaagcactatggatggagcaattgctgctgccttgctgatgtttggtgatgcaggtggtgggcccaggaaaagaaaattatcttcttcttcagagccatatgaggaagatgaatttaatgatgatcaatctataaaaaagacaagactggatcatggagaggaatcaaatgagtctgcagaatctagcagtaattgggaaaagcaggaaagtattgtactgaaattgcaaaaggaatttcccaattttgataaacaggaacttagagaagtactcaaggaacatgaatggatgtacacagaagctttagaatctctaaaagtgtttgcagaagaccaagatatgcaatatgtatcacaaagtgaggttccaaatggaaaagaagtttcttcaagaagtcaaaattaccctaaaaatgcaactaaaacaaaactaaaacagaaattttcaatgaaagcacaaaatggctttaacaagaaacgtaaaaaaaatgtttttaatccaaagagagttgttgaagactctgaatatgattcaggttctgatgtcggtagttcactagatgaggactatagtagtggtgaagaagtgatggaggatggctataaaggtaaaattcttcacttccttcaagatgcttcaattggtgaacttactttgattcctcagtgttctcagaaaaaggctcagaagataacagaactccggccctttaatagttgggaggctctgttcacaaagatgtccaaaactaatggcttatcagaagatttgatatggcactgtaaaacactgatccaagaaagagatgtagttataaggcttatgaacaaatgtgaagacatttcaaataaattgaccaaacaagttaccatgcttactggaaatggaggtggatggaacatagaacaaccttccattctaaaccaaagtttgtcactcaagccctatcagaaggttggtttgaattggctggcattggtacataaacatggacttaatggcattttggcagatgaaatgggcctaggaaaaactattcaagccattgcatttctggcatacctctatcaggagggtaataatggtcctcatttgatcgttgttccagcttcaactatagataactggttaagggaagttaatttatggtgccctactttgaaggtcctctgttactatggttctcaagaagaacgtaaacaaattagatttaacattcatagtagatatgaagattacaatgtaattgtgaccacatataactgtgcgatcagcagttctgatgaccgtagtctgtttcgacggctgaaacttaattacgcaatttttgatgagggccatatgctgaagaatatgggctccattcgctaccagcaccttatgacaattaatgcaaataaccgtttgctgctcacaggcacacctgtacagaacaatctgttagaactcatgtcgctgttgaattttgttatgccacacatgtttagtagtagcaccagtgaaatacgaagaatgttttcctctaagacaaaatcagcagatgagcaaagcatatatgaaaaggagagaatagcacatgcaaaacaaattataaagccatttattctcagaagagtaaaagaagaggttctcaagcagttaccccccaagaaagatcgaattgagttgtgtgcaatgtcggagaagcaggagcaactctatttgggtcttttcaacagattgaaaaaatctatcaataacttggtcacagaaaaaaacacagaaatgtgcaatgtcatgatgcagttgaggaaaatggccaatcatcctttattacatcgccaatattacacagctgaaaaactcaaggaaatgtctcagcttatgctaaaggaacctacacattgtgaggctaaccctgacctgatctttgaagatatggaagttatgacagacttcgaactacatgtactttgtaaacagtaccgacacattaataactttcagttagacatggacttgattttagattctggaaaatttcgagttttaggatgcatcttgtctgaattgaaacagaagggtgatagagttgtgttatttagccaatttaccatgatgctggatatcttagaggttctattaaaacatcatcagcataggtacctcagattagatggaaagactcagatttctgaaaggattcatctaattgatgagtttaataccgatatggatatctttgtgtttctgctatcaacaaaagctggtggattaggaataaatctgacttcagcaaatgttgttatacttcacgatattgactgtaatccttataatgacaaacaagcagaagatagatgccatagagtaggccagactaaagaagtactagttataaaactaataagccaagggacgattgaagaatccatgctaaaaattaaccaacagaaattgaaactagaacaggatatgactacagtagatgaaggtgatgaagggagtatgccagcagatatagccacattactaaaaacatcaatgggcctgtgaaataagaactgtgaactctcaattgatgaggaaatatcaacttggtgcactcaaggacatttacattatgatgaccatggggtttatgaacatttataactttttataatttccatattacatttctcatagtatggacaactttttgccactaactgaattctccaaatactcacacgtgaaatttcaaaaaagaagccacaaatatgtagttctgaagatgttgaataatcattttacaaagcagttttctgaatggggattagttggtgattgtttgtaacaaatatgctaatgctttagaaatgtcagtatttttgtaattatttctacctccaaatatatatatattgtctttcactggataatgtgtgtagatttttacatgtgccttatttgacaatgcttatgtcttgtttttgcttgtctcatttgaagttcttttttattatgttaaagaatgcagctgtatagattatatagctttcattttattgctatttgaagcagatgttcaccaatgtcagcaagaactcaacctgaatttaaaggtggcattccatatactaacatcccccaggtcctctcaagtacttctgctgaaacaaatttatttggctaggcactaagttgttttccagtgaatagtaactaaagaagcccctaccttgctccatggattaattccttctgttcattttccaactgcactaattgtgcatattactctgcctaatcttgtgcatgttttcattgatttccctctcccggcttttgcttctcttgaaactgttgcccagtcacttctgctccaattctcttcctctctaaatagtagtttattactgccacatctccatgcatcagcaaaatgttggtgacatttttctagcctggcagaacagattacttaaagctatttcatttcaaagcagactgaatgtgacttcatctaaaggcagcattaggtactgcatggaaataggtcattaacttgaaactcttatcaaaatatattttaccagtttccagaatttccagtacaggaccgcctgaagagagagccattgttcaattccaattcagtgtgagtgacaaagtgaaatttagaagtgaagttgtctatttgatatttaactctttattaaatctttctttaaatttctgcctgtcagtctatattgctgtttttattatacatcagtttctttgtataacttgtgagttccatgtgttttgtttttattatgtaaatatcattataaataaacttatttataaatcaaa

SEQ ID NO: 30553 - DNA, 1209 bp, Homo sapiens
gcgtcaacttccgggcggatgcccgccagcacggcctccgccgctccccttctttggcccctttgtgtccccgcagtgtcgaggcgcgggccctggcaggtcctttctcgaggcagggggcacggtagcacagggagcttctctttgtgggcgggcgcgaggcccgctagggggttatactggggaacgtgcctgcgcgtgcttggatagttcatttaaagcccccatccctgcaaggtggtgctttctaccaatatgaatcttttcaacctggaccgttttcgctttgagaaaaggaataagattgaggaagcgcccgaagcaacccctcaaccttcccagcctggcccttcttcaccaatttctcttagtgctgaagaggagaatgctgaaggggaagttagcagggcaaacactcctgattcagatataactgaaaaaacagaagattctagtgttccagaaactccagataatgaaagaaaagcaagtatatcatatttcaaaaatcaaagaggaatacagtatattgatttgtcttctgatagtgaagatgtcgtttccccaaattgctccaatacagttcaagagaaaacattcaacaaagatacagtgattatagtttctgagccatctgaagatgaagagtcccaaggccttcctaccatggcacgtagaaatgatgatatttcagaactggaagacctttcggaattggaagaccttaaagatgctaaacttcagactttgaaggaactttttccacaaagaagtgacaatgatttacttaagttgattgaatcaacaagcactatggatggagcaattgctgctgccttgctgatgtttggtgatgcaggtggtgggcccaggaaaagaaaattatcttcttcttcagagccatatgaggaagatgaatttaatgatgatcaatctataaaaaagacaagactggatcatggagaggaatcaaatgagtctgcagaatctagcagtaattgggaaaagcaggaaagtattgtactgaaattgcaaaaggaatttcccaattttgataaacaggaacttagagaagtactcaaggaacatgaatggatgtacacagaagctttagaatctctaaaagtgtttgcagaagaccaagatatgcaatatgtatcacaaagtgaggttccaaatggaaaaaaaaaggctcagaagaagaagaaa

SEQ ID NO: 30554 - DNA, 1345 bp, Homo sapiens
ggaagtgggaagagagaaaggttgtgatggcggctatagctgcatccgaggtgctggtggacagcgcggaggaggggtccctcgctgcggcggcggagctggccgctcagaagcgcgaacagagactgcgcaaattccgggagctgcacctgatgcggaatgaagctcgtaaattaaatcaccaggaagttgtggaagaagataaaagactaaaattacctgcaaattgggaagccaaaaaagctcgtttggagtgggaactaaaggaagaggaaaagaaaaaggaatgtgcggcaagaggagaagactatgagaaagtgaagttgctggagatcagtgcagaagatgcagaaagatgggagaggaaaaagaagaggaaaaaccctgatctgggattttcagattatgctgctgcccagttacgccagtatcatcggttgaccaagcagatcaaacctgacatggaaacatatgagagactgagagaaaaacatggagaagagtttttcccaacatccaatagtcttcttcatggaacacatgtgccttccacagaggaaattgacaggatggtcatagatctggaaaaacagattgaaaaacgagacaaatatagccggagacgtccttataatgatgatgcagatatcgactacattaatgaaaggaatgccaaattcaacaagaaagctgaaagattctatgggaaatacacagctgaaattaaacagaatttggaaagaggaacagctgtctaatcccttcaagaactgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgtatatggctgtttaatctttgaagcattttgggcttaagattgccagcagcacacatcagatgcagtcattgttgctatcagtgtggaatttgatagagtctagactcgggccacttggagttgtgtactccaaagctaaggacagtgatgaggaagatggcagtggccaccggaggactggagcagtccctcctcatggcggcctgtgaccaaggtcggggaggagtggagctatccttccatgatctgatcatgtacagttccctttttaaaaagcaataaatgcttgggattagaatttctaa

SEQ ID NO: 30555 - DNA, 926 bp, Homo sapiens
ggaagagagaaaggttgtgatggcggctatagctgcatccgaggtgctggtggacagcgcggaggaggggtccctcgctgcggcggcggagctggccgctcagaagcgcgaacagagactgcgcaaattccgggagctgcacctgatgcgggaatgtgcggcaagaggagaagactatgagaaagtgaagttgctggagatcagtgcagaagatgcagaaagatgggagaggaaaaagaagaggaaaaaccctgatctgggattttcagattatgctgctgcccagttacgccagtatcatcggttgaccaagcagatcaaacctgacatggaaacatatgagagactgagagaaaaacatggagaagagtttttcccaacatccaatagtcttcttcatggaacacatgtgccttccacagaggaaattgacaggatggtcatagatctggaaaaacagattgaaaaacgagacaaatatagccggagacgtccttataatgatgatgcagatatcgactacattaatgaaaggaatgccaaattcaacaagaaagctgaaagattctatgggaaatacacagctgaaattaaacagaatttggaaagaggaacagctgtctaatcccttcaagaactgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgtatatggctgtttaatcttt

SEQ ID NO: 30556 - DNA, 2522 bp, Homo sapiens
agacactggccgcgggccaccatctggacgcgatcccccgctagggcctccctggtctgggccaaagttggtggccaccttcgcgcgggctgcgccctccttctcttccctgccctcctcccccggggcccgcgcccgctgcctccagcacgcgcgtcggcaggctcggcaagcgaagaggagcggctcgccccagggcgcccctcgcccagcctgccggccaggcgagcgcgacgagagtctccccgcaccccttcctctcccgggggccgagagggttgggctccgccccggcgccgcagctcccgactccccgccgctcgggctgccgccgctgccccgcgcccggcgctcggggcagccgggggcgcaggcggagagcgcagggcggggagaggcgtggggagcagagcggcgctgaggggagggcagaggaggagagagcctggcagcggaggagcagaggcgggcgccgcaccgccccgcacgctcgctcgctcgggagagtcgcgggcggccgcttgggcgcacttgccgggtcaccttgtcccggaggagaaatggcttccctgaggcaagtgtaacctacattcccagcccaccagcctgacgcccagccagggagagagtaccatggatggcatcattgaacagaagagcatgctggtgcacagtaaaatcagtgatgctggcaagaggaatggtttaattaacaccagaaacttgatggccgagagcagagatggtctggtgtctgtttacccagcgccccagtaccagagccaccgggtgggggccagcacagtgccggccagcctggacagcagcaggagtgagccgatgcagcagctgctggaccccaacaccctgcagcagtcagtggagtcccgctaccggcccaacatcatcctctattcagagggcgtgctgcgctcctggggggacggtgtggccgccgactgctgcgagaccaccttcatcgaggaccggtcgcccaccaaagacagcctcgagtacccggatgggaagttcattgacctctcagctgatgacataaaaatccacaccctgtcctacgatgtggaggaggaggaggagttccaggagctggagagcgactactcaagcgacacagagagtgaggacaatttcctcatgatgcccccgcgggaccacctgggcctcagtgtcttctccatgctctgctgcttctggcctctgggcatcgcagccttctacttgtcccatgagaccaacaaagccgtggccaagggggacttgcaccaggccagcaccagctcccggcgggccctattcctggcagtgctgtccatcaccattgggactggcgtctatgtgggcgtggccgtggccctcatcgcctacctctccaagaacaaccacctgtgagcttcctgcgaatggagggggagcacccggggccaggtctgtgtggacgtggaggaagcaggcataccgcatgatgctgtacagtacaaatgattgccaaatgatgccacgaagccctgggatttcctacccatggatttattttgtttttatcctttaatttcatgttcacagcactgtgtagagcaccagacagacgggcactgctaatccttccaaaggaaagctccaaagatcccagcccgcaaggctgtctctggatggattctggtggatgaatggcaacgcggctctctgcagcctgccagtgcccagagtgccaccgcattagcaatatacaaacagtccaaaaaagtgtttattttttatggaatacggtgcaataggcagaggacaagggacacatcactcttctgtctgtggccctgctggagtcctttgtgccccccggagtccacacgccttccctgcaagacgagaatggggctgggaagaaagaggcaacaccacggctggcaggagccccgctgcactgctctgcagacccattggcctgaccctgagaagcagagccagcaaagcccgggacctgcccctctttctttcccttcacaccaccccagcctcaggatgtcaagccacctccggaacgtgtctacactccacagctaccccgcagcaatacgcactcttgggacctcgctgatctaggatggggaggcaggccaccgcccctcccaagactcctcaagaaagagccccgcggttgctccggaaactcgaggcactgcagctatgggcactgcctcagcctaaagacacaggggcgcctcccaatcaccgcgctggcggatgctcaccccgtcataagcagaaactagtgatcctggaaatgagatgggccttactctgtcgactaaatgaatagctattttcttgtcattttttaaagtgcaactcttgcttcatgctgcttaagttaccagatgaatgctgagaaataagtaatcacagacattttaataccatttcattgctgttttacgagtgttcattacttaacaaaaaattatcttttagctttttcgcttaagacttttctttctgatgaa

SEQ ID NO: 30557 - DNA, 2607 bp, Homo sapiens
ggcggcggcgggctgcgggcgggagctgtccgcggtgctgaagcggcggctgctcagggacgcggggacgagagcaggggagccctcctgggagttccaccgcgaccgcgaggcgggggcgccgtcgctcaccggcccatgccgagcccccgagccccgcggaggaggcgggaccgtccgcggcgggacaggctctgaggactgctcagctggcccaggcccccctccccagcagctgccccagaaccatggagagtctgagtgaactacagaacccgctgctgcccaggagccctgcccatctccatggcccctatccctacccggagaccccacccagctggtcctgccaggaaaagctctactcctacctcctaggtggcgctgggcctgccggagcccaccagctcctggacccagggtccctgcagctggccgtggaggcctggtaccggcccagctgcctcctggggagagacaaggtcaaggagcccagggcaggcagctgtgagacaagcttcacagaggacagggagccccaggaggggcctccagagcagcccacaggacctggccaagctgcagagaatgtcaccatccagactgtgtcctatggggtacaagaggagctgcgggaccaggaggatgaccaggaggaagaggagagcgatgccacttcaacggagagtgaaagtgaagacaacttcctcacgctgcctcccagggaccacctgggacttactctcttctccatgctctgctgcttctggccactgggcattgctgccttctacttctcccaggggaccagcaaggccatctccaaaggggacttccgcctggccagcaccacctcccgccgggccctcttcctagccacactcgccatcgccgtgggggccggtctctacgtggctgtggtggtggctctggcagcttacatgtcccagaacggtcatggctagtagccagtagggcctgcatcctgactcccctgcccacctgaggaagcagtggggcttggagttgcagaccctatggaaaggcccggcccctgaagatgatcccgtgagagtggcttgctgagggggagacccccattccacagcctgcagagctcagccttcacttctgcttgcccgctgctcccagccccagagcagggcccggggcgccactctctaacccaggctacagacgggaaacagaaggcagggctgcccaccaggccatcccagcagggcctagctccatccattctgcccattccctagaggatctcctgccctacagccagcccaccacctaccctgccaacctccccacagagaaagagcaggaggttacagggagaaaagggggtgcccagagcacaaggggacccgtcccaatcctttcagcccacagggatcttcacctggggacagcctgagcttcccccaactccactgtctggccccatcatgcccagacctcagcaggccaagaaggaaatacgtggaggcaagggggcctcttgctgtctctgattctagagggtgcttatctctgcatgggcttgtgaggcactgtagattctagatagggaagaggagcctcggtatgtaaactctgaaccaagggcaggttcttggagcttcttcatgcgggtgcaaaaggcagttgcaatgacagagaatagagggtcctgaaatattgctgtactacatgactcttcctactctccccccactccccgcccctatcatccttttctgggctttgcctgggggtccgtgagctggtgccatcacaagtagactagacccagagagtgccctcagctcaccagccactgagcgcacggccctaggtccagccctacagaaaacgcagcaaggagagaccctagggagtagtgagtatagatgagggaagggactcagggaaggaatggcctgctgagtagtcagcggtgcttaggaaggcttcctggaggaggtatcccttgagcaagtcctaggatgaatagaattcatctaagggatttggtcacataactctttgtatttgtaggcagggatgtggcaggaaccttccatgggaagcttccaggctgtttggattctgcctggaacatctgggctggagccaaactacagccattcctaagggttctgccaactcaaggaggaacgtcacacctgtctctcaaagaccaatgatgttttcccatctctgaatgctagggggtcagtggtgggtacctggttacccctggggcatcttcactgatatctctgctcagtgccagtctcaacaccctcagccactagggcacatccagaattttagagacatctccaggtaggcggggggcagcaccaatgtgggcaggcctgtctggactcaagctacaggcccctgctgtgcatgatgtgggaacctggtcattcccatgccccatccagagcccagggctgtggctccaccactgagcatcccttgtcccactgtcctcccctgcctcgggcactgcccagccctccactcctgcatcacagcagttttaaggtcccattattgtactgatttatccttgtaataaatgtttctgtaacacctggt

SEQ ID NO: 30558 - DNA, 2420 bp, Homo sapiens
gacaggctctgaggactgctcagctggcccaggcccccctccccagcagctgccccagaaccatggagagtctgagtgaactacagaacccgctgctgcccaggagccctgcccatctccatggcccctatccctacccggagaccccacccagctggtcctgccaggaaaagctctactcctacctcctaggtggcgctgggcctgccggagcccaccagctcctggacccagggtccctgcagctggccgtggaggcctggtaccggcccagctgcctcctggggagagacaaggtcaaggagcccagggcaggcagctgtgagacaagcttcacagaggacagggagccccaggaggggcctccagagcagcccacaggacctggccaagctgcagagaatgtcaccatccagactgtgtcctatggggtacaagaggagctgcgggaccaggaggatgaccaggaggaagaggagagcgatgccacttcaacggagagtgaaagtgaagacaacttcctcacgctgcctcccagggaccacctgggacttactctcttctccatgctctgctgcttctggccactgggcattgctgccttctacttctcccaggggaccagcaaggccatctccaaaggggacttccgcctggccagcaccacctcccgccgggccctcttcctagccacactcgccatcgccgtgggggccggtctctacgtggctgtggtggtggctctggcagcttacatgtcccagaacggtcatggctagtagccagtagggcctgcatcctgactcccctgcccacctgaggaagcagtggggcttggagttgcagaccctatggaaaggcccggcccctgaagatgatcccgtgagagtggcttgctgagggggagacccccattccacagcctgcagagctcagccttcacttctgcttgcccgctgctcccagccccagagcagggcccggggcgccactctctaacccaggctacagacgggaaacagaaggcagggctgcccaccaggccatcccagcagggcctagctccatccattctgcccattccctagaggatctcctgccctacagccagcccaccacctaccctgccaacctccccacagagaaagagcaggaggttacagggagaaaagggggtgcccagagcacaaggggacccgtcccaatcctttcagcccacagggatcttcacctggggacagcctgagcttcccccaactccactgtctggccccatcatgcccagacctcagcaggccaagaaggaaatacgtggaggcaagggggcctcttgctgtctctgattctagagggtgcttatctctgcatgggcttgtgaggcactgtagattctagatagggaagaggagcctcggtatgtaaactctgaaccaagggcaggttcttggagcttcttcatgcgggtgcaaaaggcagttgcaatgacagagaatagagggtcctgaaatattgctgtactacatgactcttcctactctccccccactccccgcccctatcatccttttctgggctttgcctgggggtccgtgagctggtgccatcacaagtagactagacccagagagtgccctcagctcaccagccactgagcgcacggccctaggtccagccctacagaaaacgcagcaaggagagaccctagggagtagtgagtatagatgagggaagggactcagggaaggaatggcctgctgagtagtcagcggtgcttaggaaggcttcctggaggaggtatcccttgagcaagtcctaggatgaatagaattcatctaagggatttggtcacataactctttgtatttgtaggcagggatgtggcaggaaccttccatgggaagcttccaggctgtttggattctgcctggaacatctgggctggagccaaactacagccattcctaagggttctgccaactcaaggaggaacgtcacacctgtctctcaaagaccaatgatgttttcccatctctgaatgctagggggtcagtggtgggtacctggttacccctggggcatcttcactgatatctctgctcagtgccagtctcaacaccctcagccactagggcacatccagaattttagagacatctccaggtaggcggggggcagcaccaatgtgggcaggcctgtctggactcaagctacaggcccctgctgtgcatgatgtgggaacctggtcattcccatgccccatccagagcccagggctgtggctccaccactgagcatcccttgtcccactgtcctcccctgcctcgggcactgcccagccctccactcctgcatcacagcagttttaaggtcccattattgtactgatttatccttgtaataaatgtttctgtaacacctgg

SEQ ID NO: 30559 - DNA, 488 bp, Homo sapiens
ggcggcggcgggctgcgggcgggagctgtccgcggtgctgaagcggcggctgctcagggacgcggggacgagagcaggggagccctcctgggagttccaccgcgaccgcgaggcgggggcgccgtcgctcaccggcccatgccgagcccccgagccccgcggaggaggcgggaccgtccgcggcgggacaggctctgaggactgctcagctggcccaggcccccctccccagcagctgccccagaaccatggagagtctgagtgaactacagaacccgctgctgcccaggagccctgcccatctccatggcccctatccctacccggagaccccacccagctggtcctgccaggaaaagctctactcctacctcctaggtggcgctgggcctgccggagcccaccagctcctggacccagggtccctgcagctggccgtggaggcctggtaccggcccagctgcctcctggggagagacaaggtcaag

SEQ ID NO: 30560 - DNA, 3203 bp, Homo sapiens
tgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtggcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatgctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgggatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaacaaatcccagtctctgaccaatgccttcaaccttccagagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggccca

SEQ ID NO: 30561 - DNA, 3165 bp, Homo sapiens
tgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtggcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatgctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgggatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaaagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggccca

SEQ ID NO: 30562 - DNA, 3039 bp, Homo sapiens
gtaaataaaggcagctaaagctgactgctggttgcgcaaaatccccctggctcttctggctaaagtcctaccactccctgtacctggcagcagcctgtcttctgggcctcacctacacacgtctgggtaggagccagtcatctccatccatccacagccatgaatttcctccggcgacgtctctctgacagcagcttcatggccaacctgcctaatggctatatgacggacctgcaacgcccagatagctccaccagctcacctgcttcccccgccatggagaggaggcacccccagcccctggctgcctccttctcctctccaggatccagcctttttagctccctctccagtgccatgaagcaggcccctcaggccacctcaggactgatggagcctccaggtccctccacgcccattgttcaaagacccaggatcctgttggtgatcgatgatgcccatacagactggtcgaagtatttccatgggaagaaggtgaatggagagattgagatccgagtggagcaggctgaattctcagagttgaacctagctgcctatgtgaccgggggctgcatggtggacatgcaggtcgtgagaaatgggaccaaagtggtgagcagatccttcaagccagacttcatcctggtccgccagcatgcctacagcatggccctgggggaagactaccgcagcctggtcatcggcctgcagtatggagggctgcctgctgtcaactctctctactccgtctacaacttctgcagcaagccctgggtgttctctcagctcattaagatcttccattccctgggtcctgagaagttcccgcttgtggagcaaacatttttccccaaccataagccaatggtcacagccccacacttcccggtggtagtcaagctgggacatgcccacgctggaatgggaaagatcaaagtggaaaaccagcttgacttccaggacatcaccagcgtggtcgccatggccaaaacctacgccaccaccgaggccttcatcgactccaagtacgacatccgcatccagaaaattggatccaactacaaggcttacatgagaacctccatctctgggaactggaaggccaacacaggctctgccatgctggagcaggtggccatgacagagaggtacaggctgtgggtggacagctgctcggaaatgtttggcggcctggacatctgtgccgtcaaggctgtccacagcaaggatggcagagattacatcatcgaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaaggaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaacaaatctcagtccctgactaacagcctcagcacatccgacacctcccagcgtgggaccccaagtgaagacgaggccaaggctgaaaccatccgcaacctgaggaagtcttttgccagcctgttctctgactaacgccatccaggctgggaggggaagagtgctctgctacactcgtccccctcctgcctcatcttccttctcagccttggttcctgatgggaacagaatggagggcctgagaacatactttctaaatgcctttgacccaggaaccgattatctatatttgttcccattttccttcaccgtgacattccagcattgtctgactgtgaggtgggcctttgagagcctccaggttcctcaaaacaggcctgagcgatgggcatcacaccctctgcctacccacgtgcctgcttacctgccagataaccaagtgagatgtctgcgagtggctagttttcacattcttactagtgtttggctcacctttgggcaaaggccccctctaggccttgccccacctccatcaaacgcagacactgtagtcagacctcagcaatataggaggcaataatcttttaacagtgttttgcaaacaaacaaaaagagaaaaatcccagccaggggaactcgccacctgcccacgctagttccatccacgctcaagacccgcccttagaccaggcaggcaaaggcccccatcacactcggccactagtggggtcctgaggccaagaaagaaaccagaccctgtatgacaagtggggtctttcagaacacgacagaaacaggggggcccttgtaatgccactcatactcagagcattattcttatttggacagccaagggcagatcacaggttattgtaggaataaagactagtttacaaaggagaaagaggccctggacttcccaaggaaagggtcaggttagggctcctgtacccattctgttccaccactgtttgatctctctggcctcccaccaggaatgccgtttcctttttatggatctgttgggaaccagagagaatcaacagatcaatgacataggatccgaagtgcaatgatagtcacttctagtttggcatttcacaaactctgtacagcaaggtattggtaggttactcaatttcaaaagggccccatggccaaatatgtttaggaaccgctgtttgtatttctttttttggagacgcattgtatataatatatgtcaaaggctttcggaattcctgcaggaaagaaatcagctttgttaaatcc

SEQ ID NO: 30563 - DNA, 3126 bp, Homo sapiens
gctcccgggacccggagcggatcgactggcgggcgccgcgccgaggcaccaccgggcgccgagttcctggcggctcgcacgcaggtaaataaaggcagctaaagctgactgctggttgcgcaaaatccccctggctcttctggctaaagtcctaccactccctgtacctggcagcagcctgtcttctgggcctcacctacacacgtctgggtaggagccagtcatctccatccatccacagccatgaatttcctccggcgacgtctctctgacagcagcttcatggccaacctgcctaatggctatatgacggacctgcaacgcccagatagctccaccagctcacctgcttcccccgccatggagaggaggcacccccagcccctggctgcctccttctcctctccaggatccagcctttttagctccctctccagtgccatgaagcaggcccctcaggccacctcaggactgatggagcctccaggtccctccacgcccattgttcaaagacccaggatcctgttggtgatcgatgatgcccatacagactggtcgaagtatttccatgggaagaaggtgaatggagagattgagatccgagtggagcaggctgaattctcagagttgaacctagctgcctatgtgaccgggggctgcatggtggacatgcaggtcgtgagaaatgggaccaaagtggtgagcagatccttcaagccagacttcatcctggtccgccagcatgcctacagcatggccctgggggaagactaccgcagcctggtcatcggcctgcagtatggagggctgcctgctgtcaactctctctactccgtctacaacttctgcagcaagccctgggtgttctctcagctcattaagatcttccattccctgggtcctgagaagttcccgcttgtggagcaaacatttttccccaaccataagccaatggtcacagccccacacttcccggtggtagtcaagctgggacatgcccacgctggaatgggaaagatcaaagtggaaaaccagcttgacttccaggacatcaccagcgtggtcgccatggccaaaacctacgccaccaccgaggccttcatcgactccaagtacgacatccgcatccagaaaattggatccaactacaaggcttacatgagaacctccatctctgggaactggaaggccaacacaggctctgccatgctggagcaggtggccatgacagagaggtacaggctgtgggtggacagctgctcggaaatgtttggcggcctggacatctgtgccgtcaaggctgtccacagcaaggatggcagagattacatcatcgaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaaggaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaacaaatctcagtccctgactaacagcctcagcacatccgacacctcccagcgtgggaccccaagtgaagacgaggccaaggctgaaaccatccgcaacctgaggaagtcttttgccagcctgttctctgactaacgccatccaggctgggaggggaagagtgctctgctacactcgtccccctcctgcctcatcttccttctcagccttggttcctgatgggaacagaatggagggcctgagaacatactttctaaatgcctttgacccaggaaccgattatctatatttgttcccattttccttcaccgtgacattccagcattgtctgactgtgaggtgggcctttgagagcctccaggttcctcaaaacaggcctgagcgatgggcatcacaccctctgcctacccacgtgcctgcttacctgccagataaccaagtgagatgtctgcgagtggctagttttcacattcttactagtgtttggctcacctttgggcaaaggccccctctaggccttgccccacctccatcaaacgcagacactgtagtcagacctcagcaatataggaggcaataatcttttaacagtgttttgcaaacaaacaaaaagagaaaaatcccagccaggggaactcgccacctgcccacgctagttccatccacgctcaagacccgcccttagaccaggcaggcaaaggcccccatcacactcggccactagtggggtcctgaggccaagaaagaaaccagaccctgtatgacaagtggggtctttcagaacacgacagaaacaggggggcccttgtaatgccactcatactcagagcattattcttatttggacagccaagggcagatcacaggttattgtaggaataaagactagtttacaaaggagaaagaggccctggacttcccaaggaaagggtcaggttagggctcctgtacccattctgttccaccactgtttgatctctctggcctcccaccaggaatgccgtttcctttttatggatctgttgggaaccagagagaatcaacagatcaatgacataggatccgaagtgcaatgatagtcacttctagtttggcatttcacaaactctgtacagcaaggtattggtaggttactcaatttcaaaagggccccatggccaaatatgtttaggaaccgctgtttgtatttctttttttggagacgcattgtatataatatatgtcaaaggctttcggaattcctgcaggaaagaaatcagctttgttaaatccaaa

SEQ ID NO: 30564 - DNA, 1332 bp, Homo sapiens
atgaatttcctccggcgacgtctctctgacagcagcttcatggccaacctgcctaatggctatatgacggacctgcaacgcccagatagctccaccagctcacctgcttcccccgccatggagaggaggcacccccagcccctggctgcctccttctcctctccaggatccagcctttttagctccctctccagtgccatgaagcaggcccctcaggccacctcaggactgatggagcctccaggtccctccacgcccattgttcaaagacccaggatcctgttggtgatcgatgatgcccatacagactggtcgaagtatttccatgggaagaaggtgaatggagagattgagatccgagtggagcaggctgaattctcagagttgaacctagctgcctatgtgaccgggggctgcatggtggacatgcaggtcgtgagaaatgggaccaaagtggtgagcagatccttcaagccagacttcatcctggtccgccagcatgcctacagcatggccctgggggaagactaccgcagcctggtcatcggcctgcagtatggagggctgcctgctgtcaactctctctactccgtctacaacttctgcagcaagccctgggtgttctctcagctcattaagatcttccattccctgggtcctgagaagttcccgcttgtggagcaaacatttttccccaaccataagccaatggtcacagccccacacttcccggtggtagtcaagctgggacatgcccacgctggaatgggaaagatcaaagtggaaaaccagcttgacttccaggacatcaccagcgtggtcgccatggccaaaacctacgccaccaccgaggccttcatcgactccaagtacgacatccgcatccagaaaattggatccaactacaaggcttacatgagaacctccatctctgggaactggaaggccaacacaggctctgccatgctggagcaggtggccatgacagagaggtacaggctgtgggtggacagctgctcggaaatgtttggcggcctggacatctgtgccgtcaaggctgtccacagcaaggatggcagagattacatcatcgaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaagttagtttttcacca

SEQ ID NO: 30565 - DNA, 632 bp, Homo sapiens
ggattacaggcgtgagccaccctgtccggcgggaatgtaaattaatacggccattatggaaaacggcatggaggttcctcagaaaactaaaaatagaactaccatatgatccagcaggctcacttctggcaggtaaataaaggcagctaaagctgactgctggttgcgcaaaatccccctggctcttctggctaaagtcctaccactccctgtacctggcagcagcctgtcttctgggcctcacctacacacgtctgggtaggagccagtcatctccatccatccacagccatgaatttcctccggcgacgtctctctgacagcagcttcatggccaacctgcctaatggctatatgacggacctgcaacgcccagatagctccaccagctcacctgcttcccccgccatggagaggaggcacccccagcccctggctgcctccttctcctctccaggatccagcctttttagctccctctccagtgccatgaagcaggcccctcaggccacctcaggactgatggagcctccaggtccctccacgcccattgttcaaagacccaggatcctgttggtgatcgatgatgcccatacagactggtcgaagtatttccatgggaagaaggtgaa

SEQ ID NO: 30566 - DNA, 855 bp, Homo sapiens
ttgggtttgggaggtcaggtttgtcatgccatttccgatttccagtcatcctgggggcaggatgaaatttcagagtggtttcctggccaagctagaagcagagaatagctatggatacagcacctcgtgtatctatccagcacttacttggctttttctgagtgccaggaactgtgccaagccctagcagcatgaagaatggcctttggggagcttctggggctaagagggacagtaggaggagcaattgcagtgcagggtagtgcggaagactcgagatggagaagaggacggtgaggaagccaggaaggtttcagagaggagcaggtaaataaaggcagctaaagctgactgctggttgcgcaaaatccccctggctcttctggctaaagtcctaccactccctgtacctggcagcagcctgtcttctgggcctcacctacacacgtctgggtaggagccagtcatctccatccatccacagccatgaatttcctccggcgacgtctctctgacagcagcttcatggccaacctgcctaatggctatatgacggacctgcaacgcccagatagctccaccagctcacctgcttcccccgccatggagaggaggcacccccagcccctggctgcctccttctcctctccaggatccagcctttttagctccctctccagtgccatgaagcaggcccctcaggccacctcaggactgatggagcctccaggtccctccacgcccattgttcaaagacccaggatcctgttggtgatcgatgatgcccatacagactggtcgaagtatttccatgggaagaaggtgaatggagagattgagatccgagtggagcag

SEQ ID NO: 30567 - DNA, 974 bp, Homo sapiens
gcttatcacaagggcgtcttattcctccactaaacaggtgtctgtggagggcacacctgcttagcaggacacggggcccattcctaaccttgggggctcccagtctggtggtggagacatagtaagcaaggggtgacagtgccgtggataagctgtcccgtgtgaaaccaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaaggaggccctcgccaagctcaatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaacaaatctcagtccctgactaacagcctcagcacatccgacacctcccagcgtgggaccccaagtgaagacgaggccaaggctgaaaccatccgcaacctgaggaagtcttttgccagcctgttctctgactaacgccatccaggctgggaggggaagagtgctctgctacactcgtccccctcctgcctcatcttccttctcagccttggttcctgatgggaacagaatggagggcctgagaacatactttctaaatgcctttgacccaggaaccgattatctatatttgttcccattttccttcaccgtgacattccagcattgtctgactgtgaggtgggcctttgagagcctccaggttcctcaaaaca

SEQ ID NO: 30568 - DNA, 497 bp, Homo sapiens
cgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggcatgggagatgcactcttgaatgtccctctgttcctcggcttccccattttctccccactcaccctctcccccatgtgtggcactgcctattctgccc

SEQ ID NO: 30569 - DNA, 1353 bp, Homo sapiens
gcgcaggggagggggcgggggcgccgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctggagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcagctgttttgtgcctagtgatgaattaggtggggtccttggctccaggagcccacaggctggggaggagaaaacaaacacatcaatatctcttccaaatggacagccgtggacagttaccaggtaggtagcggccccatacatgggctgcctagaggcgttcatggtccccattgctgagctgtgggtgcagagcaatagcctctcccttcacagcggtgtgaagagtgacctcactgtccttagggttagcatcctggccgaggatgtcacagggctcctggtctggctctgtcctcatgtgctatgtgaccctgacaaacccgtgcacctctctcagcctcagtccacttacctgaactgaggggtgataatggaccaacctctcaaggctgttgtgccaatgaaacaaaggccagcccagggcttagcacaagcatgctcaataaatgtaagctcttttgttcattca

SEQ ID NO: 30570 - DNA, 4391 bp, Homo sapiens
gcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctgggcgggccaggctgtgctggccttccagcggtaccagattggcgccgactcggccctcttctcccaggactacatggaccccagccaggactccagcatgccttacgcgccctacgtggagcccactgggccggatcccgccggtatgggcggcacctaccagcagccggccaacaccttcgacaccgagccccagggctaccagtcgcagggctactgagccacagtgaccgcctgcccccgcccctccccatctgtcccctctctccacacccagcccctgctcctgcccaggctgccctgcccagcgcctcatcagcctctgccttgtcccactgaggtccagggtagctcggggcaggggtggggcagtccagtgttggggactgtctacgtatgtgcaagtatatcccagggcatgtgccccgcaggggcctagagggtgggggccaggggtatttgcattcatacattgtgtcatcaagcattccttgagcgcctactgggcatccggcctgtgctgggcatgggtggtgacattggcagaaatggccactggaaaggggagcgatgagctgtggaggaagccctggtggtaccagaggccagaatggtgggaaagacagatccagataatgctgggaagtgtggctacaccgtggcttggtcatagggtgagtgtaaacacccacaggacactgggggctgtcaccctgctctggcagtcctgctaagagtgtcagggccgtctccattttatggttgaggaaactgaggtctagagaggtcaagattacttgcccagaatcactcaggcagctagtgatagaggtggggccaagcccaggctgcccgactgcagaccacgtgctcttccctggccacccacctcctaccatccccacgcttggggcttccctgctcagtgttactgtcattctgggaggccttggggccctcagccccttgagacaccctgattctgctgcatgccaagggcctgttctgccccagctgttcctcctcccctggggacagccccacctccgggtccctccacccacatccccctggtcctacccctggcccttggcctcctccaagagggctcaccccgggtgctgctctgtgctctgcgtgtcccacagacgcttgttccagggggctccagcaaaccccttcgtggtctctcaaaggactgatcactgtccttgcctctaggaggggtcactaagcccttacctagggctgggtggacaacaaggcacagatgagggtgtgactggcccgaggtcacggtgagtgagtggcaaagctggccctgacgcctgggtttcttggccccagctgcccagcaggtgcctcgattccctgcccttgtgacctcccaggaaacagaactgatctgggacactatgtcacctctcctctcatctggggtcagtcagggttcgggggctgcagcagccaagcgcatgagaggtgtttccttggccttccagaaggcccactgtggagccagcctccctatgggaggcagagcggcaaggacagggctttggaatcagccaggtcggctcctgggctgtggccgtggagagacactgcccccaggatgacacaggcaagagcccctgaggcatgggaggcccagggaagaccatgggctgtaggggagagtgtggcaggtgacccaaaggcccaaagagggccgtggggcctgaggaggtcataatctcttctgagtgggggcaggtcgattcttgcacaaggtgggctcttcactgagccataagggacagggaggtatgggagagcgctgggggcccatccccctgtccacccagtgtccactggcctgtccttcagggagcagagcagagcaggtggtggacgggcccagtgctgggtgttttcaccaccatccccccatcccccatctaagaatcctaagaggcaggcgatccctcacctgcttactcactcagcagttacccggcccctgtgctggagataccaagggcatgggtggtccctgcttcgatggccccaaagctgggccagagttaagggaaagaggaggaagtcctaagcagagaagtagcaccattatccccatttaacagaagggaaactgaggctcggcaagcataggcgagttggcagtggaacacggatctaaactcaggtgtgtccaagtcctcccaaaggacagcagtgatggagaggaccccagccagctgtgtgacagctggttgttgctgacttcattttccaatccggagaaggggctctgtccacagtcccccgccgccaggtggcccacatgggaccagcatgggggcaggttatctgttggcctgaagagtgaaacctgtaccaggccaaaggtgagggcgtgagtgagggcaggagtgtttatggcagagtgaagttctgtgcccaccacaagaggctgtgagatgttctgaccctcacccactgtccaccaaaagcctctcctgctgatgggcactaggagacctcagggtactgcccatctgtttctcctcgggtgccagccagctgctggtgatcctcagccggagggcagggtaccaggtaagcttaactccatcttgggtgtttgtgacaggccctgcctgccaccctaggcagggaaagctgtcaagactcctgccaggaatggggggtgctgagtcatctcacgaagaatccctcactcttcccgggttcagcccagaagcccttccaggcatgatcttccccatcaggctgggctctggcagggacctgcccaggatggagatgagagagggtgagagatggagggcgagatttggatgggacccagggctcctgactctgccctggaaggttcatggggaaactcgctccttctgttggcagaggacagcccctggggaaccccaggcccaactctgtccggtatcccttttcctcccagctgccctcccctacttctcccttgctcccaaagctttccttggagaagggccctcctgcagctggaccctgcagggtggctccctcctccccatcaagcacaagagagggcccaggaaaaaaggtttcacataagtgtagagtcgcaaggacgcttagagtcggcagagtctggggtagggagacagcgacttgtccaaggtcaagcacagagggagaggttcaggagtcaggtcttctgccttctgagttggctcatcctgggcagtcacagactgtcctgcctgcacggctcctatccacctgggggtgtcgcagttgaggggctaattcccaggggactgacgttagttccctactccatccttccctggtgattcttgatcttcaaagcctcggggatcccaggtttccccatgtaactgagacaccctgcctgttagccctgggagacccctaaccttggcccaagacccctttgattctctaaggagcacgaaagggggaatgcccctcccaggagtttatgggagaagggactgggccggctgcctcccagcgatgcacttgacctgacactccccatgtcctggtgcgcacagcccttgtcggtgccccggcccctcccgcagcgttactgcctgtgtatagtataaatatatatattttctatatataagatgtataatataaggctccacaaatatatctgtgtgtgtgtgtgcgtgtgtgtgcggtgaagggcggtccccatcctgggcccccactctagacccccccaccacctggttaagtctcgagtgaatccagtggccccgtggcaccctcctttatgacatccatccatctgtggtgaaccaagtgaaggtggtgacttctggtgacatagtaataaagtgaagactcagaacccaccagcgattgcaa

SEQ ID NO: 30571 - DNA, 1295 bp, Homo sapiens
ccagcaggcatgcctccttggtctcatgttgaccttagagtttgggattctggaattcgatccttcatggataggcagctggacacagaggtcgtgggtgagctggaggagcaggcccggatgtgagctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctggagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcagctgttttgtgcctagtgatgaattaggtggggtccttggctccaggagcccacaggctggggaggagaaaacaaacacatcaatatctcttccaaatggacagccgtggacagttaccaggtaggtagcggccccatacatgggctgcctagaggcgttcatggtccccattgctgagctgtgggtgcagagcaatagcctctcccttcacagcggtgtgaagagtgacctcactgtccttagggttagcatcctggccgaggatgtcacagggctcctggtctggctctgtcctcatgtgctatgtgaccctgacaaacccgtgcacctctctcagcctcagtccacttacctgaactgaggggtgataatggaccaacctctcaaggctgttgtgccaatgaaacaaaggccagcccagggcttagcacaagcatgctcaataaatgtaagctcttttgttcattca

SEQ ID NO: 30572 - DNA, 564 bp, Homo sapiens
accgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctggagatctggggccacatcacctccatagccccatcccaagagccctccccataacccacagc

SEQ ID NO: 30573 - DNA, 1694 bp, Homo sapiens
ggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccgcacaagcctttcatcaacatcttaaaatagtaactgtg

SEQ ID NO: 30574 - DNA, 2051 bp, Homo sapiens
cgccgcggccggcgcgcgctcccgggaggcggcagcggctgcagcgttggtagcatcagcatcagcatcagcggcagcggcagcggcctcgggcggggccggccggacggacaggcggacagaaggcgccaggggcgcgcgtcccgcccgggccggccatggagggcgcctccttcggcgcgggccgcgcaggggccgccctggaccccgtgagctttgcgcggcggccccagaccctgctccgggtcgcgtcctgggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaatcagcagcgtccgcgaccgccggcgcgcggtgttgctggacctgggcttctcaggactctggtccttcctgtggttcgtgggcttctgcttcctcaccaatcagtggcagcgcacggcgccagggccggccacgacgcaggcgggggacgcggcgcgggccgccatcgccttcagcttcttctccatcctcagctgggtggcgctcaccgtgaaggccctgcagcggttccgcctgggcaccgacatgtcactcttcgccaccgaacagctgagcaccggggcgagccaggcctaccccggctatccggtgggcagcggcgtggagggcaccgagacctaccagagcccgcccttcaccgagaccctggacaccagccccaaagggtaccaggtgcccgcctactagcggctggcaggcacagaccagggctccaaggccaccccaccaacgcaggccccagggtctccgggacctcccttgggtccttccagctcagtgccgcggacagagtaggtggccgctttgcgccatccggggccaagagggggtggacccgcgtgtctgggctgcccctgccaagttcccccagtccctcagcacctggccccaggactgaggtcctgagaaggggatagcactgcccaggacgtgtgtccctagcctggaatggactggcctggggaaggctttcccctcttgggccacacctgctcactctggggttgggggtccagctgccctctacgatcaggtgcaggggctgcccaggacaaagcgggggcaggggaaagacaccaccctcgccccaagactggggatcctggccactgttcccatcccatgtccctgtgggtagtgactgtctcgtttctgtcatggtggtgcgtcccgtccggagccactctccactttctctcacaggctgctagaacagcccagccctgtcagtgttgtgatcatggtccagtcttcgggtttcacctcctagtactccacaagctgctcctctctctgtggccccggcccctgcccaggtgtgggtggttctggccaggaaggcacaaggtagctgtgggccaagacaccagccctgtcctagcccttcagtaagaccttgccaggagaggagaaggatgcctgggtgccaggcaagacaagcccctcagcaggagagaggcccagaggctccagctggccaccgtgccccacaagatggcccctgtgtggttccctttaccttggcttcctggcccagtccctgcctctccacctgcaccctgcttcctggcccagtcccaggttggagtccctctgcatagctgactactcatgcattgctcaaagctggcttttcacattaagtcaacaccaaacgtggttgccacatttcatcagacagacacctccctctggagatgcagttgagtgacaaccttgttacattgtagcctagaccaattctgtgtggatatttaagtgaacatgtttacaatttttgtatatatcactctctccctctcctgaaagaccagagattgtgtattttcagtgtcccatgttccgactgcaccttctttacaataaagactgtaactgagctgactgtga

SEQ ID NO: 30575 - DNA, 1213 bp, Homo sapiens
atcagcatcagcatcagcggcagcggcagcggcctcgggcggggccggccggacggacaggcggacagaaggcgccaggggcgcgcgtcccgcccgggccggccatggagggcgcctccttcggcgcgggccgcgcaggggccgccctggaccccgtgagctttgcgcggcggccccagaccctgctccgggtcgcgtcctgggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaagcgggggcaggggaaagacaccaccctcgccccaagactggggatcctggccactgttcccatcccatgtccctgtgggtagtgactgtctcgtttctgtcatggtggtgcgtcccgtccggagccactctccactttctctcacaggctgctagaacagcccagccctgtcagtgttgtgatcatggtccagtcttcgggtttcacctcctagtactccacaagctgctcctctctctgtggccccggcccctgcccaggtgtgggtggttctggccaggaaggcacaaggtagctgtgggccaagacaccagccctgtcctagcccttcagtaagaccttgccaggagaggagaaggatgcctgggtgccaggcaagacaagcccctcagcaggagagaggcccagaggctccagctggccaccgtgccccacaagatggcccctgtgtggttccctttaccttggcttcctggcccagtccctgcctctccacctgcaccctgcttcctggcccagtcccaggttggagtccctctgcatagctgactactcatgcattgctcaaagctggcttttcacattaagtcaacaccaaacgtggttgccacatttcatcagacagacacctccctctggagatgcagttgagtgacaaccttgttacattgtagcctagaccaattctgtgtggatatttaagtgaacatgtttacaatttttgtatatatcactctctccctctcctgaaagaccagagattgtgtattttcagtgtcccatgttccgactgcaccttctttacaataaagactgtaactgagct

SEQ ID NO: 30576 - DNA, 1002 bp, Homo sapiens
ggcgaaaggaagggcgggccctcaggtgacgcagattggccctccagagaaggggcggccccttctcaggtgccgtcacccccaaacctcagcactgccattccaggtccttaaaggggagaccgcgattctaagaagcagccaagcccagggctggcctgaagcccccggacggcagtgcccagcaggcagcgcccagcaccctggctcccacctcccagtggccccaaaggaaaacagctgccatgcacatccccaaaagcctccaggagctggccaacagcgaagccgtgcagtttctgagaaggcccaagaccatcacgcgggtcttcgaaggggtcttctccctgatcgtcttctcctccctgctgaccgacggctaccagaacaagatggagtctccgcagctccactgcattctcaacagcaacagcgtggcctgcagctttgccgtgggagccggcttcctggccttcctcagctgcctggccttcctcgtcctggacacacaggagacccgcattgccggcacccgcttcaagacagccttccagctcctggacttcatcctggctgttctctgggcagttgtctggttcatgggtttctgcttcctggccaaccaatggcagcattcgccgcccaaagagttcctcctggggagcagcagtgcccaggcagccatcgccttcaccttcttctccatccttgtctggatattccaggcctacctggcattccaggacctccgaaatgatgctccagtcccttacaagcgcttcctggatgagggtggcatggtgctgaccaccctccccttgccctctgccaacagccctgtgaacatgcccaccactggccccaacagcctgagttatgctagctctgccctgtccccctgtctgaccgctccaaagtccccccggcttgctatgatgcctgacaactaaatatccttatccaaatcaataaagagagaatcctccctccagaagggtttct

SEQ ID NO: 30577 - DNA, 4722 bp, Homo sapiens
atggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtaaacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggggctaggagtcctgcacccactagaaaggaatttggaggtattggagcccctcccagtcctggggtagctaggagagagatggaagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaagtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataa

SEQ ID NO: 30578 - DNA, 7059 bp, Homo sapiens
aagccggcggggggcggggagctgctgcggccagacccacgggcagccgggcgggcggacgcctccaagaccagtctctgcctccgcagcgtcagcgggagcgggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtaaacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggggctaggagtcctgcacccactagaaaggaatttggagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaacaggagcaaccatcagggtaacaggtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcactagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtctttaccatg

SEQ ID NO: 30579 - DNA, 6942 bp, Homo sapiens
aagccggcggggggcggggagctgctgcggccagacccacgggcagccgggcgggcggacgcctccaagaccagtctctgcctccgcagcgtcagcgggagcgggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtaaacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaaggctggaaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaagtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcactagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtctttaccatg

SEQ ID NO: 30580 - DNA, 7094 bp, Homo sapiens
atgcggaagagatgggcctgctggagcggaagtgacgctcccggcggctgtggcggcggctgcgggagaaggaggaggaggagccggaggaagagggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtaaacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggggctaggagtcctgcacccactagaaaggaatttggaggtattggagcccctcccagtcctggggtagctaggagagagatggaagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaacaggagcaaccatcagggtaacaggtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcactagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtcttta

SEQ ID NO: 30581 - DNA, 4852 bp, Homo sapiens
gcggcgcaatgcggaagagatgggcctgctggagcggaagtgacgctcccggcggctgtggcggcggctgcgggagaaggaggaggaggagccggaggaagagggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtaaacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggggctaggagtcctgcacccactagaaaggaatttggaggtattggagcccctcccagtcctggggtagctaggagagagatggaagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaagtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgcca

SEQ ID NO: 30582 - DNA, 7378 bp, Homo sapiens
gcggggagctgtcgcgggcagcgcgccctcgggaggacgtggccccggcccccgcccgcagtgggcccgaccctcatggccctgagcaaagggctgcggctgctggggcgcctgggggccgagggggactgtagcgtgctgctggaggcgcgcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggagtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaaggaatccgtgacccacagagctagacagataagatgcatagttgaccagtcataaaaggcggtgtttaggtgatcaggatgccgttggtggcatttacgtgctttatatgatttttacctctgtaacaaacacaagaaataaacagaatggtccttaacagagtttgggggagagagcaagatgggttccttggagaagctgatttgccaagatgcacatcgctattaacagccagagtcataaatgaaatgaaattgaagaattcattcaaatgctcttttccctataacctcttttctcaccaaaaaggagataaatttgaaaacagataaatgtaacaaccagtcaaagaagcaggggaaaagtaagctcctccaaagttgcttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagttggtagtaggtatggttctcataccagaattctcttaaaaaaaaaaaaaaggacaattggaattgccttatttatttttaaaatcaatgcttactagttggtaggattcccaggtcagcagcagggttgattaaataatcttgacaatgagcagctgccatcttgggggatttcattctgtggttttttaaatgtttcgtctttgatgctaccatccagggcttcttattgtgaccttgtagcctattttgttcctgctgttctctaacatggtgcagttcacgcagactggtttaggtacttcacaactcaccattgtctctctgaccccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtctttttttaaa

SEQ ID NO: 30583 - DNA, 5091 bp, Homo sapiens
cctaattacacattttgggagagcatagccaggaaattgcatctgtgaaaagaaaatacaaattttcctctagatgagtttgtgaacgcctgtgtggccccagcgctctgagaggtggggcctagaatgagtccgagtgttctcagctcctgcagctcttaccataccaattgctgccaaccttctgggattcctgggtcctggaaacccggcagcaacactgtgtctcaagcctacagtgggcatgctggcgaggactgcaggcatggtcatgactgttttgaataattatatgcgaggaatgtttttaaccaaaggccccaaagcatccgaagcctggcttcaaggtggaggagtaaggaggatgagtctgggacgtggggtggttcgtggcgcagacctctattgtggaagtgtcatgatcgcattcttggatattgactcgattctatatgggtctctcgaatggaacccctgcgagtagctggagaactcaaccttctagacagtgatctagatgttgacaccaaagtcagacacacctggtctcctggtgccctgcagtattatggtcgtgcggagctacaagcgtctgatcacaggtgaggtcctgacttccatggcgttttctcctgtgctgggcaaggcagcgtctccctctccgcaggaaaatgcatgctgtccccataaggatgtgtgtgcgcatgggggtgcattttgtgtgcatacaatacaccaaagaacaaagaatgatggaacaaatatctgtggacccaccaccaagaactaattaatcttagcattttgtcattgctccatatcataaatgacatcattgatgaaaatttcaaagatgcaacctacgtattttgcggcttttatattttcttaaatgatgtcgttgtgcaacttgcttttttgttactatttttgagatacagtcgtgttgatgttatagctctggtgcattcatttgtaactgctgtctagtatcccactaaatatatccatggaacttacaacttatccattcacctcttgatgaatattttctccaggattttatgattacaaacaccatagggtttttaaatctgggatgcacaaccttttttttttttttttttttgagagagagtcttgctctattgcccaggctggatggagtacagtggtgtgatctcagctcactgcaacctccgcttcccagattcaagcaattctcctgcctcagcctcccaagtagctgggattacaggtgcacaccaccatgcctggctaatttttgtgtttttagtagagacggggtttcaccatgttggccaggctggtcccaaactcctgacctcaggtgatccacccaccttggcctctcaaagtgttgggattacaggcgtgagccaccgcacctggccctaggatgcagggctttttaaatgctctgtgcatcatgcattgaggatagagtggaggcagcagagggagcaccgtgggcaccagcacctgtgccctgggattgctgcagaggaagactcaccctgcagaatgtctttaaagacagaggagaggatggcatttgagggtgtgaagaaggaagagtttgatcttcccaaggctgctgcctaaactctcatgtcagtttcaacttttacaaggaaagaaattaagaaaaagaagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggagtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaa

SEQ ID NO: 30584 - DNA, 499 bp, Homo sapiens
gcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctgaggcagccacaggttttcatctggccttggtgctttggattccccagaagtgaattcctgatttctgccggaagaaggggaccctcccca

SEQ ID NO: 30585 - DNA, 3973 bp, Homo sapiens
gcaaagtgaaactctggcaagttgcgggcgcgcggggagctgtcgcgggcagcgcgccctcgggaggacgtggccccggcccccgcccgcagtgggcccgaccctcatggccctgagcaaagggctgcggctgctggggcgcctgggggccgagggggactgtagcgtgctgctggaggcgcgcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggagtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagattgttttttgctctcgctctcaagcttctcagccttgcttactgcttcaaagacatgagtttgtaaggacagtagcagcccaaagactggcatctgtagacacatctggatcttccgtttga

SEQ ID NO: 30586 - DNA, 7271 bp, Homo sapiens
gcaaagtgaaactctggcaagttgcgggcgcgcggggagctgtcgcgggcagcgcgccctcgggaggacgtggccccggcccccgcccgcagtgggcccgaccctcatggccctgagcaaagggctgcggctgctggggcgcctgggggccgagggggactgtagcgtgctgctggaggcgcgcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggagtctcggacagtgaactcgggggagacgacctctctgatgtccccggccccacagcactggctcctcccagcaagtcacctgctctcaccaaaaagaagcagcatccaacgtacaaagccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaaggaatccgtgacccacagagctagacagataagatgcatagttgaccagtcataaaaggcggtgtttaggtgatcaggatgccgttggtggcatttacgtgctttatatgatttttacctctgtaacaaacacaagaaataaacagaatggtccttaacagagtttgggggagagagcaagatgggttccttggagaagctgatttgccaagatgcacatcgctattaacagccagagtcataaatgaaatgaaattgaagaattcattcaaatgctcttttccctataacctcttttctcaccaaaaaggagataaatttgaaaacagataaatgtaacaaccagtcaaagaagcaggggaaaagtaagctcctccaaagttgcttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagttggtagtaggtatggttctcataccagaattctcttaaaaaaaaaaaaaaggacaattggaattgccttatttatttttaaaatcaatgcttactagttggtaggattcccaggtcagcagcagggttgattaaataatcttgacaatgagcagctgccatcttgggggatttcattctgtggttttttaaatgtttcgtctttgatgctaccatccagggcttcttattgtgaccttgtagcctattttgttcctgctgttctctaacatggtgcagttcacgcagactggtttaggtacttcacaactcaccattgtctctctgaccccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtcttttttt

SEQ ID NO: 30587 - DNA, 547 bp, Homo sapiens
agtgcaatggcgcgatctcggctcaccacaacctctgcctcctgggttcaagcaattctcctgcctcagcctcctgaatagctgggactacaggcatgcgccaccatgcccaactaattttttgtatttttagtagagacggggtttttccatgttggtcaggctggtctgaaactccgacctcaggtggtccacctgcctcagcctcccaaagtgctgggattacagccatgagccgccgtgcctggccgacctctcttctcttttaagatgtttctttatgcctcgggacctgctcctcctgcaggaacctgcaggtggggaggtcaaggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactg

SEQ ID NO: 30588 - DNA, 2060 bp, Homo sapiens
agtgcaatggcgcgatctcggctcaccacaacctctgcctcctgggttcaagcaattctcctgcctcagcctcctgaatagctgggactacaggcatgcgccaccatgcccaactaattttttgtatttttagtagagacggggtttttccatgttggtcaggctggtctgaaactccgacctcaggtggtccacctgcctcagcctcccaaagtgctgggattacagccatgagccgccgtgcctggccgacctctcttctcttttaagatgtttctttatgcctcgggacctgctcctcctgcaggaacctgcaggtggggaggtcaaggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagtttgccaaaggtgggaagctagagaaattggagaccctcttgaggccacagttaaagctgcactgggaagacttcgatgtgttcacaaagggggagaacgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccagggtgagggcagtgactttgggggagacaaaatccaattgcacctaacctgacatgtcacgcttgaccctttagtggccatcgtcttgtggaatttcatctttggtgtcttccctcctcacaatgtctaaatagcaccatggcctgactctcaagaatgctgcctcgcaagtaactgacctttttcctttcccagatgtttagaagagttagcagatggtgaatctctcttttctctttgcatacagtgatggtgaagtcttaggctttcatcagtagaatcttttcgtca

SEQ ID NO: 30589 - DNA, 2080 bp, Homo sapiens
gggcgcagcgccgagattgattcaccttcacctgtgctgcactccagctgacccaagtaggaagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcggtaaatggccaagacctaaagaacctgctgcaccaggatgctgtagacctctttcgtaatgcaggctatgctgtgtctctgagagtgcagcacaggttacaggtgcagaatggacctataggacatcgaggtgaaggggacccaagtggtattcccatatttatggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaaggtattgtttgaaggaaaactgaagaaaagacttggcttagaacaaatgaggagttatatattttactaggacttttgatagaaattcagctacaacccaaagagagaaagattgagtcttcctgtcaccataggcaataccttttttcttagctggcatgccataaaggccagctatgtgatattagaggaagaaaggatttttctttttaatgatcttccttgggaaattattgtggcctttatttaatttctaactacgtacctgggtgcctatatcgacaaagagtgagaagagcatttttacttttttaaaaaagcaaatacatatatacacatacgtatgcaaatattatagtataatagtgatccctatggagaattaaaggtgagaaagctactttgtggtgtctaggtttctgataaaagggatgatcttaactgaagaatttaaagagatacttaaacagagcaaatgtagtaggaacaagggagtgagccttataagaggacgttcagtctcatttattaaaataataactgagactgggagaggtggctcatgcctgtaaatcccagcactttggtagcctgaagtgggagattgcttgagtccaggagaccagcctgggcaacatagcaaaacctcatctctatttaaaaaaaaaatagaaaaaaatgtaataactgaagcaactaattaaaaatcttagaagaacaatatttattcttataacagccaactatggtgagttattataaggtaaattgccataatccagcgctgctcacatctaaaaaactttgaggtgtaaaggtaaatcgtaccaatctctgggctgccctagtgacttttttgatacctcagagtcctattgaagaaccaggtggaatgattgtggtaagggctatagtgctggagccaaacaccccagcaagaaaactctaaaaggacaaaagataaggtagtgcctccaaggtggcacctgaaccctctcaggctactttttggtttctactaacaaacctgagggaaggaactgcctccctggcaggatgggcatcaaatcaactctggcttcagatttagttaaaatgaggccgggtgcagcggctcacacctgtcatctcagcactttgggaggccgaggcaggcagatcacaaggtcaggagttcaagaccagcctggccaacatggtgaaaccccatgtctactgaaaatacaaaaattacctggacatggtggcgcgttcctgtaattccagctactcaggaggctgaggcaggagaactgtttgaaccaggacctgggagacggaggttgcagtgagccaagatcacgccactgcactccagcctgggctacagagcaagactccatctc

SEQ ID NO: 30590 - DNA, 1452 bp, Homo sapiens
gcattgcgcaggcgcgctgcctggagtcctgcccccagcggcggttgctccaatcaccactggaggctccctcccgaggcaccctcgctggcgagctgagaggaaatggcggggaggtccctgacatcgaaggccgagcccaccgcaggagccgtggacagggctgagaaggccggagggcaggacacgtcctcacagaaaattgaagacttgatggaaatggtgcaaaagctgcagaaagtgggaagcctagagccccgagttgaggtcctgattaaccggattaatgaggtccagcaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggctcccagaccaggtagaccagtgacatggtggagttgaagagagaggctcactgcagagcactgtttccatggaaaaatggaacatggcaaagtgcagaaattcttcagtcagtccaggacagacgagttctctaagatgcagttaatcatacctgtcttaaacaaactggcaatatactatcaaacatgacttttaaatcaagtggaagttagaaaatatattgaactgagtggcaatgaagacaccacattttaaaactgtaattcagttaagcccacaattagaaggaactttagcttttattggttcaccacaattttttaagaaatcaaccaatgattgttcagttaatgaataaaaggcctttgacacagttcacctattcatgtgaaaaaaaaagactaataaatagtcagcttcccttag

SEQ ID NO: 30591 - DNA, 1309 bp, Homo sapiens
gcattgcgcaggcgcgctgcctggagtcctgcccccagcggcggttgctccaatcaccactggaggctccctcccgaggcaccctcgctggcgagctgagaggaaatggcggggaggtccctgacatcgaaggccgagcccaccgcaggagccgtggacagggctgagaaggccggagggcaggacacgtcctcacagaaaattgaagacttgatggaaatggtgcaaaagctgcagaaagtgggaagcctagagccccgagttgaggtcctgattaaccggattaatgaggtccagcaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggccagtcccaagcccctaaaaggagaaagacctggagctgcacaccaagcagggcctgatgtcctcataggccaggaggacacactccaccccgaccttagcccaaggggctttcaggaaataaaggagctattttgatacagctaagtctactggtgaggagtaggggtcaggcccaagatccccagtctcctgtgactgattgaagccttggcttgactctgcctcttggtctgggccagaggtacatcacaggttttcaataaatgcttccttaacctcctgg

SEQ ID NO: 30592 - DNA, 1377 bp, Homo sapiens
gctcaggctggagaagggccgcgggacccggggaacgcggcctggaggacgaggaggactgggttcccggaggcaacaggaccggctcggcatctacagctactggcaggacacgtcctcacagaaaattgaagacttgatggaaatggtgcaaaagctgcagaaagtgggaagcctagagccccgagttgaggtcctgattaaccggattaatgaggtccagcaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggctcccagaccaggtagaccagtgacatggtggagttgaagagagaggctcactgcagagcactgtttccatggaaaaatggaacatggcaaagtgcagaaattcttcagtcagtccaggacagacgagttctctaagatgcagttaatcatacctgtcttaaacaaactggcaatatactatcaaacatgacttttaaatcaagtggaagttagaaaatatattgaactgagtggcaatgaagacaccacattttaaaactgtaattcagttaagcccacaattagaaggaactttagcttttattggttcaccacaattttttaagaaatcaaccaatgattgttcagttaatgaataaaaggcctttgacacagttcacctattcatgtgaaaaaaaaagactaataaatagtcagcttccctta

SEQ ID NO: 30593 - DNA, 1375 bp, Homo sapiens
gctccggctgaggggccgcgggacccggggaacgcggcctggaggacgaggaggactgggttcccggaggcaacaggaccggctcggcatctacagctactggcaggacacgtcctcacagaaaattgaagacttgatggaaatggtgcaaaagctgcagaaagtgggaagcctagagccccgagttgaggtcctgattaaccggattaatgaggtccagcaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggctcccagaccaggtagaccagtgacatggtggagttgaagagagaggctcactgcagagcactgtttccatggaaaaatggaacatggcaaagtgcagaaattcttcagtcagtccaggacagacgagttctctaagatgcagttaatcatacctgtcttaaacaaactggcaatatactatcaaacatgacttttaaatcaagtggaagttagaaaatatattgaactgagtggcaatgaagacaccacattttaaaactgtaattcagttaagcccacaattagaaggaactttagcttttattggttcaccacaattttttaagaaatcaaccaatgattgttcagttaatgaataaaaggcctttgacacagttcacctattcatgtgaaaaaaaaagactaataaatagtcagcttcccttag

SEQ ID NO: 30594 - DNA, 1217 bp, Homo sapiens
acggaatggagcgacagggagtggacgtgccccatgtgaaatgcaaagaccaggaaccgcagcccttgggggagagcaaggagcatccgcggtgggaagagaactgcgaggaggaagctggtggagggccagctagtgccagttgccagctgacggtcctggaagggaagtcgggactctacttctcctctctggactcaagcattgacatcctgcagaagagagcccaggagctgatcgaaaacatcaacaagagccggcaaaaggaccatgcactcatgaccaacttcaggaacagcctgaagaccaaggtttcggatctgacagagaaattagaggagaggatctatcagatttataatgaccacaacaagatcatccaggaaaagctccaagagttcacccagaaaatggcaaagatcagccatttggagacagagctcaaacaagtctgccacagcgtggagactgtgtacaaagacctgtgtctccagcctgagcagagcctaagactcagatgggggccagaccactctaggggaaagtccccaccacgtcccggcaactcacagcccccagacgtgttcgtttcttctgtggctgaaactacttctcaggccactgcttcagaagtacagaccaacagagatggtgaatgctgacagctgccgggagactcacgccttagtgacagtctccaggagaagactgtgaggccaccatttgggccacactgagaaattgtttttcatggttctataatgcatcttggcagaaaaaaacaaaaacccaaagctccttgtgctgaactcccaaaatgtagcaagtccagcccctgccataggcccaggcttcgtgctccccacccttggcaagttctccccacccccagccccacagtttattaaatgtttgattttcaacctggccacgcttccttgccacagaggctgaaagcacccctgagctccaaggaaacacagcaagccctttcttaccctcgggagggataggagggacagcacatcggaagagcagtcacttgcctcagctgacctctgcccatctgaagccgcctctcccagagaatcccacaccccatgccctggtgtctcatcctttgctcctccccagctccttgaagcagaaggcagattgtagcctcctttttagagccaattctgtttacttcctaaagtacaaacctatttttttta

SEQ ID NO: 30595 - DNA, 3452 bp, Homo sapiens
caggaacttaagacagttcctcctggcgatgtgatggaatttaatgggacaggagaagggaacgggctttcttttcaggccagcgtggcagcgggcggtagggcgaaagggagaaggaaacgagggtttattccgttgcccactccgcgatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggcaaaagaaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaaggcatatacagtgaagacaccaacaaaaccaaaactacagcaaagagaaaacttgaatatacccattgaagaaagtaaaaaaaagagaaaaatggcctttgaatttgatattaattcagatagttcagaaactactgatcttttgagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattgttgttactttttcttgtattcatgaaaactgtttttactaagttttcaaatttgtaaagttagcctttgaatgctaagaatgcattattgagggtcattctttattctttactattaaaatattttggatgc

SEQ ID NO: 30596 - DNA, 3522 bp, Homo sapiens
ctgggagcctggcaagcccacacagcgacggttatttagccgttgaactgccagccgcccggggcccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggcaaaagaaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaaggcatatacagtgaagacaccaacaaaaccaaaactacagcaaagagaaaacttgaatatacccattgaagaaagtaaaaaaaagagaaaaatggcctttgaatttgatattaattcagatagttcagaaactactgatcttttgagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattgttgttactttttcttgtattcatgaaaactgtttttactaagttttcaaatttgtaaagttagcctttgaatgctaagaatgcattattgagggtcattctttattctttactattaaaatattttggatgcaaa

SEQ ID NO: 30597 - DNA, 2554 bp, Homo sapiens
ccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagtagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggcaaaagaaaacacagctactcttaaagaaaaaaaa

SEQ ID NO: 30598 - DNA, 2597 bp, Homo sapiens
ttatttagccgttgaactgccagccgcccggggcccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggcaaaagaaaacacagctactcttaaagaaaaaaaagacaagaaatga

SEQ ID NO: 30599 - DNA, 5559 bp, Homo sapiens
tgcggcggtccctgaggcgcagagttgcgacgctcggcggcatagggggcggctccaccgacactacgcggacgcctcctgccgcagatacacaatcatcatcttactagttctctgtgttgctcgctaaccagtcccccagttcagtagactggagcccagagcctgcttacttgtcaggtgtttattttgtcttgctttttttttttttttaaatgaagtcaaaatgccaataagaccagatctccagcagttggaaaaatgcattgatgatgctttaagaaaaaatgatttcaaacctttgaaaacacttttgcaaattgatatttgtgaagatgtgaagattaaatgcagcaaacagtttttccacaaggtggacaaccttatatgcagggaacttaataaagaggatatccacaatgtttcagccattttggtttctgttggaagatgtggcaaaaatatcagtgtattggggcaagctggacttctaacgatgataaaacaaggactaatacaaaagatggttgcctggtttgaaaaatccaaggacattattcagagtcaaggaaattcaaaagatgaagctgttctaaatatgatagaagacttagttgatcttctgctggtcatacatgatgtcagtgatgaaggtaaaaaacaagtagtggaaagtttcgtacctcgcatttgttccctggttattgactcaagagtgaatatttgtattcagcaagagattataaaaaaaatgaatgctatgcttgacaaaatgcctcaagatgcccggaaaatactctctaaccaagaaatgttaattctcatgagtagtatgggagaaaggattttagatgctggagattatgacttacaggtaggcattgtagaagctttgtgtagaatgaccacagaaaaacaaagacaagaactggcacatcagtggttttcaatggattttattgctaaggcatttaaaagaattaaggactctgaatttgaaacagattgcaggatatttctcaaccttgtaaatggcatgcttggagacaaaagaagggtctttacatttccttgtttatcagcatttcttgataaatatgagctgcaaataccatcagatgaaaaacttgaggaattttggattgattttaatcttgggagtcagactctctcattctacattgctggagataatgatgatcatcaatgggaagcagttactgtgccagaggaaaaagtacaaatatacagcattgaagtgagagaatcaaagaagctactgacaataattctgaaaaatacagtaaaaattagcaaaagagaagggaaagaattgcttttgtattttgacgcatcactagaaatcactaatgtaactcaaaaaatttttggtgcaactaaacatagggaatctatcagaaaacaaggtatttcagttgccaaaacgtcgctgcatatactttttgacgcaagtggatcacagattctagtgccagaaagtcaaatctcaccagtcggagaagagctcgttagtttaaaggaaaaatcaaagtccccaaaggaatttgctaaaccttcaaaatatatcaaaaacagtgacaaagggaatagaaataatagtcagcttgagaaaactactcctagcaaaagaaaaatgtctgaagcatcaatgattgtttctggtgcagatagatacactatgagaagtccagtgcttttcagcaacacatcaataccaccacgaagaagaagaattaaaccaccactgcaaatgacgagctctgcagagaaacctagtgtttctcaaacatcagaaaatagagtggataatgctgcatcactgaaatctagatcatcagaaggaagacatagaagagataatatagacaaacatatcaaaactgctaagtgtgtagaaaacacagaaaataagaatgttgaattcccaaaccaaaattttagtgaactccaggatgttataccagattcacaggcagcggaaaaaagagatcatactatattacctggtgttttagacaacatctgtggaaataaaatacacagcaaatgggcatgttggacacctgtaacaaacattgaactatgtaataaccaaagagcaagtacttcgtcaggagacacattgaatcaagatattgttataaataaaaaacttactaaacaaaaatcatcctcttcaatatctgatcataattctgaaggaacaggaaaagtgaaatataagaaagaacaaaccgaccatatcaaaatagataaagcagaagtagaagtttgcaagaaacacaatcagcaacaaaatcatcctaaatattcagggcagaaaaatactgaaaatgccaagcagagtgattggcctgttgaatctgaaactacttttaaatcggttctcctaaataagacaattgaagaatcgctgatatataggaagaaatacatattgtcaaaagatgtgaatactgctacttgcgataaaaatccatctgctagcaaaaatgtgcaaagtcatagaaaagcagagaaagaattgacttctgagcttaattcctgggattcgaaacaaaaaaaaatgagagaaaagtcaaaagggaaagaatttaccaatgtagcagaatccttgataagccaaatcaataaaagatacaaaacaaaagatgacatcaagtctacaagaaaattaaaggagtctttgattaacagtggtttttcaaacaaacctgttgtacaactcagtaaggaaaaagttcagaaaaaaagctacagaaaactgaagactacctttgttaatgttacttctgaatgcccagtgaatgatgtttacaattttaatttgaatggagctgatgaccctatcataaaacttggaatccaagagtttcaagctacagctaaagaagcttgtgcggataggtcaattagattggtaggtccaaggaatcatgatgaacttaaatcttctgtcaaaacaaaagataaaaaaattataacaaatcatcaaaagaaaaatctgtttagtgatactgaaacagagtacagatgtgatgacagcaagactgatattagctggctaagagaaccgaaatcaaaaccacagctaatagactatagcagaaataaaaatgtgaagaatcataaaagtggaaaatcaagatcatccttggaaaagggacagccaagctctaaaatgacacccagtaaaaatatcacaaaaaagatggacaagacaattccggaaggaagaatcagacttccacgaaaagcaaccaaaacaaaaaaaaactataaagatctctcaaattcagaatcagagtgtgaacaagaattttcacattcatttaaagagaacataccagtaaaggaggagaatatccattccagaatgaaaacggtaaagctaccaaagaaacaacagaaagtcttctgtgctgaaacagaaaaggaactatcaaaacaatggaaaaactcatctctactaaaagatgctatacgagataattgccttgacttatctcccagatctttatctggcagtccatcatctatagaagtaacgagatgtatagagaaaataacagaaaaggattttactcaggattatgactgcataacaaaatctatatcaccttatccaaaaacttcatcacttgaatccttaaatagtaacagtggagttggaggtacaataaagtcacccaaaaacaatgagaaaaacttcctgtgtgcaagtgaaagttgttcaccaattccacgaccactgtttttgcccagacatactccaactaagagtaatactattgtaaatagaaaaaaaataagttctctggtacttacacaagaaacacaaaacagtaacagctattcagatgtaagcagttatagttcagaagaacggtttatggaaattgaatctccacatatcaatgaaaattatatacaaagcaaaagagaggaaagtcatttagcatcttcattatccaagtctagtgaaggaagagagaaaacgtggtttgacatgccctgtgatgctactcatgtatcaggccccacccaacatcttagtcgcaaaagaatatatatagaagataatctaagtaattccaatgaagtagaaatggaagagaaaggagaaaggagagcaaacttgcttcccaaaaaactgtgtaaaattgaagatgcagatcatcatatccacaaaatgtctgaaagtgtatcttcattatcaacaaatgacttttctattccttgggagacctggcaaaatgaatttgcagggatagagatgacttatgagacttacgagaggctcaattcagaatttaagagaaggaataatatccgacataaaatgttgagttattttactacgcagtcttggaaaacagctcagcaacatctgagaacaatgaatcatcaaagtcaggactctaggattaaaaaacttgataaattccaattcattatcatagaggagctggagaattttgaaaaagattcacagtctttaaaagatttggaaaaggaatttgtggacttttgggaaaagatatttcagaagttcagtgcatatcaaaaaagcgaacaacagaggcttcatcttttgaaaacttcattggctaaaagtgtcttctgtaatactgatagtgaagaaactgtttttacatccgagatgtgtttgatgaaagaagatatgaaagtgctgcaagacaggcttcttaaggacatgctagaagaggagcttcttaatgtacgcagagaactgatgtcagtattcatgtctcatgaaagaaatgctaatgtgtgaaatctagtttttatcaccatactttatctaattattattctctgtatataactgaggaaataagaatagtcctacaaagagaaaaatatacatgtcaccgaagcaagtgtaccctttataggaaccctcaaattaaaaaaaaatgtcttttaatggatgagagggaaccactataacatgagtccaagcccagaagacttctgtctatacaatatttttttttaattttggagataaaagctttaagaaactttttgagttaattatactcataaaatgagtttctttaataaattaaattttattgtgtaaaatgtattattacataaaatgtgtttttgaatcaatgcagtttggggatgaatataattaaaatatgtttaataacttagaattcaactaataaaaatttagccacacttacaagggggaggaagtccctagtttaaaatgtataactgagtggtagatcagtactttcagcacactgttggaaacatttattcagatatggctctaatgtattaggaagcactaaatggcctaaaaaagctactacattgcctaaatatgttaattcaatatagaagtcctatttcataaccaggctgtttgacaaatacttttaatctagtagtcattgtaatatcttgctagattaatttataaaaatgagtatacatttgatttgcttttaatgaagttgaaataaatgcttatgtcacttgaataaatataaa

SEQ ID NO: 30600 - DNA, 5477 bp, Homo sapiens
atacacaatcatcatcttactagttctctgtgttgctcgctaaccagtcccccagttcagtagactggagcccagagcctgcttacttgtcaggtgtttattttgtcttgctttttttttttttttaaatgaagtcaaaatgccaataagaccagatctccagcagttggaaaaatgcattgatgatgctttaagaaaaaatgatttcaaacctttgaaaacacttttgcaaattgatatttgtgaagatgtgaagattaaatgcagcaaacagtttttccacaaggtggacaaccttatatgcagggaacttaataaagaggatatccacaatgtttcagccattttggtttctgttggaagatgtggcaaaaatatcagtgtattggggcaagctggacttctaacgatgataaaacaaggactaatacaaaagatggttgcctggtttgaaaaatccaaggacattattcagagtcaaggaaattcaaaagatgaagctgttctaaatatgatagaagacttagttgatcttctgctggtcatacatgatgtcagtgatgaaggtaaaaaacaagtagtggaaagtttcgtacctcgcatttgttccctggttattgactcaagagtgaatatttgtattcagcaagagattataaaaaaaatgaatgctatgcttgacaaaatgcctcaagatgcccggaaaatactctctaaccaagaaatgttaattctcatgagtagtatgggagaaaggattttagatgctggagattatgacttacaggtaggcattgtagaagctttgtgtagaatgaccacagaaaaacaaagacaagaactggcacatcagtggttttcaatggattttattgctaaggcatttaaaagaattaaggactctgaatttgaaacagattgcaggatatttctcaaccttgtaaatggcatgcttggagacaaaagaagggtctttacatttccttgtttatcagcatttcttgataaatatgagctgcaaataccatcagatgaaaaacttgaggaattttggattgattttaatcttgggagtcagactctctcattctacattgctggagataatgatgatcatcaatgggaagcagttactgtgccagaggaaaaagtacaaatatacagcattgaagtgagagaatcaaagaagctactgacaataattctgaaaaatacagtaaaaattagcaaaagagaagggaaagaattgcttttgtattttgacgcatcactagaaatcactaatgtaactcaaaaaatttttggtgcaactaaacatagggaatctatcagaaaacaaggtatttcagttgccaaaacgtcgctgcatatactttttgacgcaagtggatcacagattctagtgccagaaagtcaaatctcaccagtcggagaagagctcgttagtttaaaggaaaaatcaaagtccccaaaggaatttgctaaaccttcaaaatatatcaaaaacagtgacaaagggaatagaaataatagtcagcttgagaaaactactcctagcaaaagaaaaatgtctgaagcatcaatgattgtttctggtgcagatagatacactatgagaagtccagtgcttttcagcaacacatcaataccaccacgaagaagaagaattaaaccaccactgcaaatgacgagctctgcagagaaacctagtgtttctcaaacatcagaaaatagagtggataatgctgcatcactgaaatctagatcatcagaaggaagacatagaagagataatatagacaaacatatcaaaactgctaagtgtgtagaaaacacagaaaataagaatgttgaattcccaaaccaaaattttagtgaactccaggatgttataccagattcacaggcagcggaaaaaagagatcatactatattacctggtgttttagacaacatctgtggaaataaaatacacagcaaatgggcatgttggacacctgtaacaaacattgaactatgtaataaccaaagagcaagtacttcgtcaggagacacattgaatcaagatattgttataaataaaaaacttactaaacaaaaatcatcctcttcaatatctgatcataattctgaaggaacaggaaaagtgaaatataagaaagaacaaaccgaccatatcaaaatagataaagcagaagtagaagtttgcaagaaacacaatcagcaacaaaatcatcctaaatattcagggcagaaaaatactgaaaatgccaagcagagtgattggcctgttgaatctgaaactacttttaaatcggttctcctaaataagacaattgaagaatcgctgatatataggaagaaatacatattgtcaaaagatgtgaatactgctacttgcgataaaaatccatctgctagcaaaaatgtgcaaagtcatagaaaagcagagaaagaattgacttctgagcttaattcctgggattcgaaacaaaaaaaaatgagagaaaagtcaaaagggaaagaatttaccaatgtagcagaatccttgataagccaaatcaataaaagatacaaaacaaaagatgacatcaagtctacaagaaaattaaaggagtctttgattaacagtggtttttcaaacaaacctgttgtacaactcagtaaggaaaaagttcagaaaaaaagctacagaaaactgaagactacctttgttaatgttacttctgaatgcccagtgaatgatgtttacaattttaatttgaatggagctgatgaccctatcataaaacttggaatccaagagtttcaagctacagctaaagaagcttgtgcggataggtcaattagattggtaggtccaaggaatcatgatgaacttaaatcttctgtcaaaacaaaagataaaaaaattataacaaatcatcaaaagaaaaatctgtttagtgatactgaaacagagtacagatgtgatgacagcaagactgatattagctggctaagagaaccgaaatcaaaaccacagctaatagactatagcagaaataaaaatgtgaagaatcataaaagtggaaaatcaagatcatccttggaaaagggacagccaagctctaaaatgacacccagtaaaaatatcacaaaaaagatggacaagacaattccggaaggaagaatcagacttccacgaaaagcaaccaaaacaaaaaaaaactataaagatctctcaaattcagaatcagagtgtgaacaagaattttcacattcatttaaagagaacataccagtaaaggaggagaatatccattccagaatgaaaacggtaaagctaccaaagaaacaacagaaagtcttctgtgctgaaacagaaaaggaactatcaaaacaatggaaaaactcatctctactaaaagatgctatacgagataattgccttgacttatctcccagatctttatctggcagtccatcatctatagaagtaacgagatgtatagagaaaataacagaaaaggattttactcaggattatgactgcataacaaaatctatatcaccttatccaaaaacttcatcacttgaatccttaaatagtaacagtggagttggaggtacaataaagtcacccaaaaacaatgagaaaaacttcctgtgtgcaagtgaaagttgttcaccaattccacgaccactgtttttgcccagacatactccaactaagagtaatactattgtaaatagaaaaaaaataagttctctggtacttacacaagaaacacaaaacagtaacagctattcagatgtaagcagttatagttcagaagaacggtttatggaaattgaatctccacatatcaatgaaaattatatacaaagcaaaagagaggaaagtcatttagcatcttcattatccaagtctagtgaaggaagagagaaaacgtggtttgacatgccctgtgatgctactcatgtatcaggccccacccaacatcttagtcgcaaaagaatatatatagaagataatctaagtaattccaatgaagtagaaatggaagagaaaggagaaaggagagcaaacttgcttcccaaaaaactgtgtaaaattgaagatgcagatcatcatatccacaaaatgtctgaaagtgtatcttcattatcaacaaatgacttttctattccttgggagacctggcaaaatgaatttgcagggatagagatgacttatgagacttacgagaggctcaattcagaatttaagagaaggaataatatccgacataaaatgttgagttattttactacgcagtcttggaaaacagctcagcaacatctgagaacaatgaatcatcaaagtcaggactctaggattaaaaaacttgataaattccaattcattatcatagaggagctggagaattttgaaaaagattcacagtctttaaaagatttggaaaaggaatttgtggacttttgggaaaagatatttcagaagttcagtgcatatcaaaaaagcgaacaacagaggcttcatcttttgaaaacttcattggctaaaagtgtcttctgtaatactgatagtgaagaaactgtttttacatccgagatgtgtttgatgaaagaagatatgaaagtgctgcaagacaggcttcttaaggacatgctagaagaggagcttcttaatgtacgcagagaactgatgtcagtattcatgtctcatgaaagaaatgctaatgtgtgaaatctagtttttatcaccatactttatctaattattattctctgtatataactgaggaaataagaatagtcctacaaagagaaaaatatacatgtcaccgaagcaagtgtaccctttataggaaccctcaaattaaaaaaaaatgtcttttaatggatgagagggaaccactataacatgagtccaagcccagaagacttctgtctatacaatatttttttttaattttggagataaaagctttaagaaactttttgagttaattatactcataaaatgagtttctttaataaattaaattttattgtgtaaaatgtattattacataaaatgtgtttttgaatcaatgcagtttggggatgaatataattaaaatatgtttaataacttagaattcaactaataaaaatttagccacacttacaagggggaggaagtccctagtttaaaatgtataactgagtggtagatcagtactttcagcacactgttggaaacatttattcagatatggctctaatgtattaggaagcactaaatggcctaaaaaagctactacattgcctaaatatgttaattcaatatagaagtcctatttcataaccaggctgtttgacaaatacttttaatctagtagtcattgtaatatcttgctagattaatttataaaaatgagtatacatttgatttgcttttaatgaagttgaaataaatgcttatgtcacttgaataaatataaatcatt

SEQ ID NO: 30601 - DNA, 3341 bp, Homo sapiens
tgcagagttcgcggcgagggtggctcgcgcaggcgcgaggctccccatcagcacctgcctggccagcctcggcctcggggatgggaaatgggcgctcggagccgcccccgcgcgtgggcgactcggtcaagatacacaatcatcatcttactagttctctgtgttgctcgctaaccagtcccccagttcagtagactggagcccagagcctgcttacttgtcaggtgtttattttgtcttgctttttttttttttttaaatgaagtcaaaatgccaataagaccagatctccagcagttggaaaaatgcattgatgatgctttaagaaaaaatgatttcaaacctttgaaaacacttttgcaaattgatatttgtgaagatgtgaagattaaatgcagcaaacagtttttccacaaggtggacaaccttatatgcagggaacttaataaagaggatatccacaatgtttcagccattttggtttctgttggaagatgtggcaaaaatatcagtgtattggggcaagctggacttctaacgatgataaaacaaggactaatacaaaagatggttgcctggtttgaaaaatccaaggacattattcagagtcaaggaaattcaaaagatgaagctgttctaaatatgatagaagacttagttgatcttctgctggtcatacatgatgtcagtgatgaaggtaaaaaacaagtagtggaaagtttcgtacctcgcatttgttccctggttattgactcaagagtgaatatttgtattcagcaagagattataaaaaaaatgaatgctatgcttgacaaaatgcctcaagatgcccggaaaatactctctaaccaagaaatgttaattctcatgagtagtatgggagaaaggattttagatgctggagattatgacttacaggtaggcattgtagaagctttgtgtagaatgaccacagaaaaacaaagacaagaactggcacatcagtggttttcaatggattttattgctaaggcatttaaaagaattaaggactctgaatttgaaacagattgcaggatatttctcaaccttgtaaatggcatgcttggagacaaaagaagggtctttacatttccttgtttatcagcatttcttgataaatatgagctgcaaataccatcagatgaaaaacttgaggaattttggattgattttaatcttgggagtcagactctctcattctacattgctggagataatgatgatcatcaatgggaagcagttactgtgccagaggaaaaagtacaaatatacagcattgaagtgagagaatcaaagaagctactgacaataattctgaaaaatacagtaaaaattagcaaaagagaagggaaagaattgcttttgtattttgacgcatcactagaaatcactaatgtaactcaaaaaatttttggtgcaactaaacatagggaatctatcagaaaacaaggtatttcagttgccaaaacgtcgctgcatatactttttgacgcaagtggatcacagattctagtgccagaaagtcaaatctcaccagtcggagaagagctcgttagtttaaaggaaaaatcaaagtccccaaaggaatttgctaaaccttcaaaatatatcaaaaacagtgacaaagggaatagaaataatagtcagcttgagaaaactactcctagcaaaagaaaaatgtctgaagcatcaatgattgtttctggtgcagatagatacactatgagaagtccagtgcttttcagcaacacatcaataccaccacgaagaagaagaattaaaccaccactgcaaatgacgagctctgcagagaaacctagtgtttctcaaacatcagaaaatagagtggataatgctgcatcactgaaatctagatcatcagaaggaagacatagaagagataatatagacaaacatatcaaaactgctaagtgtgtagaaaacacagaaaataagaatgttgaattcccaaaccaaaattttagtgaactccaggatgttataccagattcacaggcagcggaaaaaagagatcatactatattacctggtgttttagacaacatctgtggaaataaaatacacagcaaatgggcatgttggacacctgtaacaaacattgaactatgtaataaccaaagagcaagtacttcgtcaggagacacattgaatcaagatattgttataaataaaaaacttactaaacaaaaatcatcctcttcaatatctgatcataattctgaaggaacaggaaaagtgaaatataagaaagaacaaaccgaccatatcaaaatagataaagcagaagtagaagtttgcaagaaacacaatcagcaacaaaatcatcctaaatattcagggcagaaaaatactgaaaatgccaagcagagtgattggcctgttgaatctgaaactacttttaaatcggttctcctaaataagacaattgaagaatcgctgatatataggaagaaatacatattgtcaaaagatgtgaatactgctacttgcgataaaaatccatctgctagcaaaaatgtgcaaagtcatagaaaagcagagaaagaattgacttctgagcttaattcctgggattcgaaacaaaaaaaaatgagagaaaagtcaaaagggaaagaatttaccaatgtagcagaatccttgataagccaaatcaataaaagatacaaaacaaaagatgacatcaagtctacaagaaaattaaaggagtctttgattaacagtggtttttcaaacaaacctgttgtacaactcagtaaggaaaaagttcagaaaaaaagctacagaaaactgaagactacctttgttaatgttacttctgaatgcccagtgaatgatgtttacaattttaatttgaatggagctgatgaccctatcataaaacttggaatccaagagtttcaagctacagctaaagaagcttgtgcggataggtcaattagattggtaggtccaaggaatcatgatgaacttaaatcttctgtcaaaacaaaagataaaaaaattataacaaatcatcaaaagaaaaatctgtttagtgatactgaaacagagtacagatgtgatgacagcaagactgatattagctggctaagagaaccgaaatcaaaaccacagctaatagactatagcagaaataaaaatgtgaagaatcataaaagtggaaaatcaagatcatccttggaaaagggacagccaagctctaaaatgacacccagtaaaaatatcacaaaaaagatggacaagacaattccggaaggaagaatcagacttccacgaaaagcaaccaaaacaaaaaaaaa

SEQ ID NO: 30602 - DNA, 1068 bp, Homo sapiens
cgcgcttgtggaggagttgtggaggacgcctgtcgacgaccagtaactggtcctcggccattgcggaagcatctaaatatggtgtcctccggaaaaaagtattccaggaaatctgggaagccgtctgtggaagatcagtttacgagagcctatgactttgagactgaagataagaaagatctgagtggatcagaggaagatgttattgaagggaagactgcagtcattgagaaacgtaggaagaaaaggtcttctgcaggagtagttgaagatatggggggtgaagtgcagaatatgctggaaggagttggagttgacattaacaaggctcttcttgccaagagaaagagactagaaatgtataccaaggcttctctcaaaactagtaaccagaaaattgaacatgtttggaaaacacaacaagatcaaaggcagaagcttaaccaagaatattctcagcagtttctgactttgtttcagcagtgggatttagatatgcagaaagctgaggaacaagaagaaaaaatacttaatatgtttcgacagcaacaaaagattcttcaacaatctagaattgttcagagccagagattgaaaacaattaaacagttatatgagcagttcataaagagtatggaagagttggagaagaatcatgataatctacttactggtgcacaaaatgaatttaaaaaagaaatggctatgttgcaaaaaaaaattatgatggaaactcagcagcaagagatagcaagtgttcggaagtctcttcaatccatgttattctgatgactctttgaagaaagaacttgaacctaagtaatatgatacaattataacgttagctaagaagcatattgtaagtctttagaatagtttaattgtaacatctttaatcataaacctgtttcattgtaagacctccctttctgttaagtcaaatctaaatagttatgagttagttagcaactattcctaaagaatatgtattaagctttcagctctttagtaatgatagtgaatttttctctctaacactgtcaattaaataaagacgatttaatttta

SEQ ID NO: 30603 - DNA, 845 bp, Homo sapiens
gagttgtggaggacgcctgtcgacgaccagtaactggtcctcggccattgcggtgtgtttcagtcaggaagcatctaaatatggtgtcctccggaaaaaagtattccaggaaatctgggaagccgtctgtggaagatcagtttacgagagcctatgactttgagactgaagataagaaagatctgagtggatcagaggaagatgttattgaagggaagactgcagtcattgagaaacgtaggaagaaaaggtcttctgcaggagtagttgaagatatggggggtgaagtgcagaatatgctggaaggagttggagttgacattaacaaggctcttcttgccaagagaaagagactagaaatgtataccaaggcttctctcaaaactagtaaccagaaaattgaacatgtttggaaaacacaacaagatcaaaggcagaagcttaaccaagaatattctcagcagtttctgactttgtttcagcagtgggatttagatatgcagaaagctgaggaacaagaagaaaaaatacttaatatgtttcgacagcaacaaaagattcttcaacaatctagaattgttcagagccagagattgaaaacaattaaacagttatatgagcagttcataaagagtatggaagagttggagaagaatcatgataatctacttactggtgcacaaaatgaatttaaaaaagaaatggctatgttgcaaaaaaaaattatgatggaaactcagcagcaagagatagcaagtgttcggaagtctcttcaatccatgttattctgatgactctttgaagaaagaacttgaacctaagtaatatgatacaattataacgtt

SEQ ID NO: 30604 - DNA, 1120 bp, Homo sapiens
ttgcctcagaagcgtcgcggagaaggggccacctcaggtgaagcgcgcttgtggaggagttgtggaggacgcctgtcgacgaccagtaactggtcctcggccattgcggtgtgtttcaggaagcatctaaatatggtgtcctccggaaaaaagtattccaggaaatctgggaagccgtctgtggaagatcagtttacgagagcctatgactttgagactgaagataagaaagatctgagtggatcagaggaagatgttattgaagggaagactgcagtcattgagaaacgtaggaagaaaaggtcttctgcaggagtagttgaagatatggggggtgaagtgcagaatatgctggaaggagttggagttgacattaacaaggctcttcttgccaagagaaagagactagaaatgtataccaaggcttctctcaaaactagtaaccagaaaattgaacatgtttggaaaacacaacaagatcaaaggcagaagcttaaccaagaatattctcagcagtttctgactttgtttcagcagtgggatttagatatgcagaaagctgaggaacaagaagaaaaaatacttaatatgtttcgacagcaacaaaagattcttcaacaatctagaattgttcagagccagagattgaaaacaattaaacagttatatgagcagttcataaagagtatggaagagttggagaagaatcatgataatctacttactggtgcacaaaatgaatttaaaaaagaaatggctatgttgcaaaaaaaaattatgatggaaactcagcagcaagagatagcaagtgttcggaagtctcttcaatccatgttattctgatgactctttgaagaaagaacttgaacctaagtaatatgatacaattataacgttagctaagaagcatattgtaagtctttagaatagtttaattgtaacatctttaatcataaacctgtttcattgtaagacctccctttctgttaagtcaaatctaaatagttatgagttagttagcaactattcctaaagaatatgtattaagctttcagctctttagtaatgatagtgaatttttctctctaacactgtcaattaaataaagacgatttaattt

SEQ ID NO: 30605 - DNA, 2486 bp, Homo sapiens
aacgagcgcgcgccgcccccgccgcgccccgcgccgcccttgctagccgagcctcccgccccctgcattgctgatgctgctgctggcggacatggacgtggtgaatcagctggtggctgggggtcagttccgggtggtcaaggagcccctcggctttgtgaaggtgctgcaatgggtcttcgccatcttcgcctttgccacatgcggcagctacagtggggagctccagctgagcgtggattgtgccaacaagaccgagagtgacctcagcatcgaggtcgagttcgagtaccccttcaggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccgagagaataacaaagggcccatgctggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtcagtgaagcccaggaggacctggggggggcaagagctcaggagaaggcctgccccccttcccacccctataccctaggtctccacccctcaagccaggagaccctgtctttgctgtttatatatatatatattatatataaatatctatttatctgtctgagccctgccctcactccactcccctcatccactaggtgcccagtcttgagtgggccccctctcttaccccgtccctttccctgcatcccttggcccctctctgtttaccctccctgtcccctgaggttaaggggatctaaaaggaggacagggagggaacagacctcggctgtgtggggagggtgggcgtgacttcagactctctcctctctctccctccactcctcccaactctggccttggttcctccagcaatgcctgcctgaacaaaggccgttagggaaatccaactccagggttaaagaaaggcagagattgggggggcttggggtagagaggacagtttaggacccaaggtggtcttggagaggaggtgtggagtggaggggtcagcaggggggttgggttccagacagagtggatctggagtctgaaggagaggagtgcgctagagcattctggggtggggcttggaagggcgctgagggcagggttctagaaggggcgaggctttaagcgaggcagaatggtgggctccagagtaggtgggtcttggattggtaccagagcctatggaaagggtgtggcttggaacatttgggagactgagcttgattctaaaggggacagatcttgagcaaggcaagaagtgggattcaggaatgggccaagccagggttccagacagggtggggcttagaatggggcttccatggtggtttcagaaagggcagcccctccccatggtgcagtgaagaaaatgttttacaatggctgggtttgggcagtggagaggggacttggataggagcttccagatgggttttgttaggggtgggggagaatggctctggctacgacttgggacggaagtggcctgagaagagtcgagtgatatggcttgtagggtgaggcgtgggatccagagagaagcaccccaccacacacacccttccccactcccgtgatgaaacagctaggttaataggaggacagaaccaacgggtctgtgggactggcccacccctcttcccccttcccctgcgccctccctccctccacacctccacccgtcctggggtggttggaggcctggtctggagcccctatcctgcaccctctgctatgtctgtgatgtcagtagtgcctgtgatcgtgtgttgccattttgtctggctgtggcccctccttctcccctccagacccctaccctttcccaaacccttcggtattgttcaaagaacccccctccccaaggaagaacaaatatgattctcctctcccaaataaactccttaaccacct

SEQ ID NO: 30606 - DNA, 1850 bp, Homo sapiens
ccctgcattgctgatgctgctgctggcggacatggacgtggtgaatcagctggtggctgggggtcagttccgggtggtcaaggagcccctcggctttgtgaaggtgctgcaatgggtcttcgccatcttcgcctttgccacatgcggcagctacagtggggagctccagctgagcgtggattgtgccaacaagaccgagagtgacctcagcatcgaggtcgagttcgagtaccccttcaggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccgagagaataacaaagggcccatgctggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtgagtgaccggcgagcggtgcggccaaggagggtacaaggaaggagacgagcgggtcagtgaaccaataagagtcaggggtagagagtacgtaaggcgtttactggggcaagtaaggactgaagtttgaaggagccaatcaagaggcagaactacctgctaagagctgaaaaactagctaatgaatggagaaaagaagaatggtgcttcaagatggacagaatgaagagccaatgggagggaggtagaagggcaactcggcggaaaggcagggggagagaagcagagcaaccaataaagggagggaatatcgggggacttgcgcagtggcgaatcagcggagcgcaagagccacggaagcgacgaggaggtgggtcttagaagtgactgataagccaataggtgataaggccaatagatggtgagggtaaatgggcgtggatcttgaaggtcagacgagctcaccaatccgggaggaggggatagatctgccgcctctccccaacgctggaggggagggaagtagtgtggaatttcaaaggaggaagagggatagggtggggttctggaaaggtttgccggccttcttgctgggccttaaaagagaagtgagggtcggggcttggtggctcatgcctgtaatctcagcactttgggagaccgaggcgggcgggccgcttgagcccaagagttcgagaccagcctgggcaacatgatgaaatcccacctctacaaaaaatacaaaaattagccgggcgtggtggcatgcatctgtggacccatctactcaggaggctgaagtgggaggatcacttaagcccaggaggttgaggctgccgtgagctatgatcctgccactgcactccagcctgggcaacagagcgagacctt

SEQ ID NO: 30607 - DNA, 870 bp, Homo sapiens
attgctgatgctgctgctggcggacatggacgtggtgaatcagctggtggctgggggtcagttccgggtggtcaaggagcccctcggctttgtgaaggtgctgcaatgggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccgagagaataacaaagggcccatgctggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtcagtgaagcccaggaggacctggggggggcaagagctcag

SEQ ID NO: 30608 - DNA, 5374 bp, Homo sapiens
ctgataaagagctgggctgagtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagacgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggaccgccgggagagcctgcccacctccccaccctggacgccgggcgcgtcccggccccccagcagcctagacggctgggtgagcccgggcccgtgggagccaggtcgcgggagcagcatgagcagccccccgccgctgccgccgccaccgcccatgtctccctcgtggagcgagcgctcggtgtccccgctgcgacctgagaccgaggcgcggccccccagccgccagctgcaggcgcttctggcgcgaaacatcatcaatgcggcccggcgcaagagcgcctccccgcggtcggcgggcgccgagaacccgcggcccttctccccgccgagggcgccaccgcccccgcccccgcccccgcccccgcccccgcgcatgcgctcgccacagcccgcccgccccggctcggctgctgtgccgggggcagccttcgcgcccatcccgcggagcccgttgcccgccggtccttcgtcctgcaccagtccccggagcccgctgcccgcgcctcccaggcccttcctctaccgccgctcgcccacggactccgacgtgtccctcgactccgaggactccggggctaagtctccaggcatcctgggctacaatatctgtccccgcgggtggaatggcagccttcggctcaagcgtggcagcctccccgccgaggcctcctgcaccacctagagccccacccccgaccccaccccgggagggcagagccagaagaaggctcattagacctgggggacccaaagggtctggcctctttgggcagccccagagatgaggggtcagcagaggagagctctggggttggggatgggttagggacgcaagcttgagttctagcccttgctctcattcagctgttgtgtgaccctgggtaagacccttccttgtttgaccctcagctttcccatctgtttaatggtggctttggccaaggcaatccacaaacgtcaaaattccccttcccatcagtacacacaccgatgcacacacactctctctttctctctctctctctctcacacacacacacacacacacacacacacacacacacacacacactagttagtgccttggatgaggcggggcagtgtgtatatggacccctggacttgctaccttcagggttccatactcgtccctcccctcctggctctgctgtctggagtctggcaagcggggtgtgttcagaaggtcctaggcctgtgtcgcatgtccaggcactggcctgaccatccggctccctggcaccaagtcccaggcaggagcagctgttttccatcccttcccagacaagctctatttttatcacaatgacctttagagaggtctcccaggccagctcaaggtgtcccactatcccctctggagggaagaggcaggaaaattctccccgggtccctgtcatgctactttctccatcccagttcagactgtccaggacatcttatctgcagccataagagaattataaggcagtgatttcccttaggcccaggacttgggcctccagctcatctgttccttctgggcccattcatggcaggttctgggctcaaagctgaactggggagagaagagatacagagctaccatgtgactttacctgattgccctcagtttggggttgcttattgggaaagagagagacaaagagttacttgttacgggaaatatgaaaagcatggccaggatgcatagaggagattctagcaggggacaggattggctcagatgacccctgagggctcttccagtcttgaaatgcattccatgatattaggaagtcgggggtgggtggtggtggtgggctagttgggcttgaatttaggggccgatgagcttgggtacgtgagcagggtgttaagttagggtctgcctgtatttctggtccccttggaaatgtccccttcttcagtgtcagacctcagtcccagtgtccatatcgtgcccagaaaagtagacattatcctgccccatcccttccccagtgcactctgacctagctagtgcctggtgcccagtgacctgggggagcctggctgcaggccctcactggttccctaaaccttggtggctgtgattcaggtccccaggggggactcagggaggaatatggctgagttctgtagtttccagagttggctggtagagccttctagaggttcagaatattagcttcaggatcagctgggggtatggaattggctgaggatcaaacgtatgtaggtgaaaggataccaggatgttgctaaaggtgagggacagtttgggtttgggacttaccggggtgatgttagatctggaacccccaagtgaggctggagggagttaaggtcagtatggaagatagggttgggacagggtgctttggaatgaaagagtgaccttagagggctccttgggcctcaggaatgctcctgctgctgtgaagatgagaaggtgctcttactcagttaatgatgagtgactatatttaccaaagcccctacctgctgctgggtcccttgtagcacaggagactggggctaagggcccctcccagggaagggacaccatcaggcctctggctgaggcagtagcatagaggatccatttctacctgcatttcccagaggactagcaggaggcagccttgagaaaccggcagttcccaagccagcgcctggctgttctctcattgtcactgccctctccccaacctctcctctaacccactagagattgcctgtgtcctgcctcttgcctcttgtagaatgcagctctggccctcaataaatgcttcctgcattcttctgcctcctg

SEQ ID NO: 30609 - DNA, 7063 bp, Homo sapiens
agagcgcgagtgaggagcaggcgggcaggcggcgggcagccgggcagccgtggacagaggcccgggcacagccagttgctgtgccagagggtgtggtgtccggctacagattgccccaaagcggcctcacaccagagacgggttaagaagagggattggaggtccaccactccactagcccaggaaggacttatctttcgtctcagccagacctcaccccaattctgtgaatcagcggaggaaggcaaaagtgcagagagtcagaggaggctgtgtaaggagcagagaccagggctcacacagctggccccagcccaggccctggcccaggcccaggagcctgcttccctgcatcgctgaggaagaacagcaccatgctgggtcctcacctcccacctccgccccttgcacccagcgaagggaggcctaccccctgcgccttccagatccctgatggaagctacaggtgtctggctctggaagccgaggagagcagcggtgaggagggcctgcagggagaggtggggcctaccgacctggaagaggatgagggggtcagcaggagtggggacgactctgcctgcagagtcacccaggggacaccgcagctgcccaaagccctgggcatccaaccacccagctgctccagagaggaacaaggggcgtcccagcacgacgacagggccagccaggactgggatgtagtgaaggccgggcagatgatgacagccagccccagccctggccctgggcccagagtggcccagaaaccagcgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggtgtggaagccttccttctgcttcaagtaacgaaccccacgggggtcccactgccggtcaagttcccctccttgagggccagatggagagcagatgtggcaggaaatggcacagagctgagtgaggagaatggggagtccatggttcaaggtcagatgcggccaccagctggctttgtgaccttgggcgagtcgcctcccctctctgagctgaagccgcccctcccctactacaacaggggtcggactccatgtctgagcggggaggagggtcatggagagagaactgtctggcagccctgatgcggtagaggggcatcctctggcctttgtgagctgtagggatgcagagtctgatgccagcgtcttgctgggggagtggcctagaaggggatcctaacagggacttctggagcagacagagcctgccagtgcctgtggagtcagccagccgagggtctgcctcctcagctgccccaggggggcctccctcctgaggctcaagctcctggcgtctttcttcctgttgctggattctcacctccatgggcctgtctcttctgcctctgccttctggacaccgtttcctctccgctgcttcagagagctttgcctcgcctccgcctgcgctcccctccagggtccttctgctggctgcggactcggcccaccactgctgtctgacgcttttcttcctgccccctctgaggcctggctctgttttagggagatcactgggcccaggcctcagccccagttctacctggcttgctgtcaccgctctaggggtgggggacgtcccaggggatccccaggagaaggagagccctgtagggggctgtgcagatgtgggtgtgccacagggagggtggcccctagccatgtatccattggctgttttggcttcagattcaaccaagatctgcctgactaaaagaagccacctcagcgcagtggaacggggcccagggggaggcaggagaggagggttccggtcccatgtcaccttctcatttgctgtgtgactttggcccactcacattctctttgggcctcagttttatcatttatacaaggagggcttttctagctgtaacaatctgtgaggattgagaggataggctggtgctttgaagaaaggccttgtaagtgacaagacagtcccctgggaagaaagagaaaggaaatgggctattgccaaaggacaggtggcgttagatggctgtgagggtgacctggtgagggaagggttggaatgagctgctgcaggaggccaagggatgcctgggctgggctgggctgggctggcttaggctcaggattgcctggggacagtaggagcatggcaggagctggggcaggtgcatagcagtgcagtgggaagggacagaggagatcttagaattttgaggaaaatctgggacttgagacctggattctaacagaccaactgcatgtgtgtctgtaggtctcagtttccacattcatacagtgagggtgttaagtcaggtagctggagacttcccatcgcctctgacacttttggaggtgatatgatacagcccccgaccaaaccaggctttgtggggggtgagagaatacagacacaagtggcaggattcagatggaagcttcgcaaggctgggggccgaggaccacccacttctctttcccagccctagttctgggttccccagtggggcaaggggtggtggaggcagtgcccatgctgggctgagcctgcagtttttgtgagctctgggcttgtctccatgggaacaggggtgccttcttagtgagctcatttcacacagatcgagggggtatgcgtgggggagttgtgagtgagctcagctccttcaggcctggcctctcccagaacagagtgaagcccctgccctggacccctgctcccttctacccttgagggccaccaatggaagagcccgcccttcattctgcagctcctgcggccaggctgagctctgcccccaactttgttttctctcatgttctcaatacactctgcctcaaatccgtcttgcttctttctttcttccgtgctgctaggggtcagggttcccttcctcctgcctgattctagcctgggaagtggagtgggcctgctcaattactgtgtgtgaaagtgtggctgtgtcctgcgtgctgcctgcacctgccgtgtgtctggttctgcactggtacagacgtgtgctgggttggaaatgagggcttcctctctacagcactcagggagccagaaccctgtgcaaatcgcaaccttttgttctttccttccctcagagtttggccaaaaatactttagaggatttttggggaaaatgcactacctcttctcgttgaggtttgtttgggttctttacaagtggaatagaaattcctctagccagcattcgctctccagttccctcaggtcccctccctgctccccattatctaaatttggccatttcccacatttgccattgttttcactgtctggatcctaaaagcatggagtttctgcccctggtggggaggaaagaactgccatcaagggtcaggagagctgggttctagccccaggtctgcatctgattcgtgtgtgacctcagacaacctcttccaatctctgggcctcagtttccccttctgtgcagtgaaaggattacagaaggaggtcagagaccatttggtctccgacagtccaggtttgactgtgttctacttatgtattcaccccacacatgtgccctgctttgggtctggggttgggttgagtggatgctactttttgaattttcacccaccgcattcccaaggagctctggtgtgcacggtgcattgagctctctgtcagaaagtgaacagttctgatttcctgcagccttttcgtactgtgcacacccccgactcaaaaacatacacacagagtcagtgcccaggcatggctgttagggtgaggtcaggctctggcccatctccagatgatggggatctgcttaccactgccctcaacattcaatcccgtttgagcccttctgttttgtagtcttggctgaattgttatttcttccacttgttggcctcagcattccccttgtggccaccaaaggcagaaacaatgctttagagatttttaggtagttatcatagctctcctgtgcagcctactctcctggctgaagaccccaggttccgctgccttgggtggttattgactggcttgggtcatgaactctaggccctacctccctgctcagggtggcactgtggtcaggtgttgggtcatgccagagcccaccctgatttggcatttggccctagccctcctcttctagccctggagctgggaccttcctcccagctcctctccctaaactgtggggtctgccttctgcggccagcctgactgggatgttccactggcacagagaagctcccagtgtctctggctcatgtatacacaattctgaccctgggaagaaaacagtgggatcccaggctgagccttaactttcagcttgatgactgggagcttggatgtccctagggagtctctaagggtcactccagcattagtatcccatgaaaaatgtcctgctcaggctgttgtataacattcttctttaggttaaagggctccagtttggagtctgggctcatctagcagctgctacattctgtttggataaaacatacaattggtgtctatttcctttggattgggaggaattagaagactctcagttggatgagaggatgactggcttggttatggctgatcactgattggatgaaagaataaatctttggatggttctagattttgatcgggtaggaagcatggaatggactggctagctctgaactctggtggatgactgctagtgaatttggattggattaaatggcaaggtggactggtta

SEQ ID NO: 30610 - DNA, 4571 bp, Homo sapiens
gtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagacgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggtgtggaagccttccttctgcttcaagtaacgaaccccacgggggtcccactgccggtcaagttcccctccttgagggccagatggagagcagatgtggcaggaaatggcacagagctgagtgaggagaatggggagtccatggttcaaggtcagatgcggccaccagctggctttgtgaccttgggcgagtcgcctcccctctctgagctgaagccgcccctcccctactacaacaggggtcggactccatgtctgagcggggaggagggtcatggagagagaactgtctggcagccctgatgcggtagaggggcatcctctggcctttgtgagctgtagggatgcagagtctgatgccagcgtcttgctgggggagtggcctagaaggggatcctaacagggacttctggagcagacagagcctgccagtgcctgtggagtcagccagccgagggtctgcctcctcagctgccccaggggggcctccctcctgaggctcaagctcctggcgtctttcttcctgttgctggattctcacctccatgggcctgtctcttctgcctctgccttctggacaccgtttcctctccgctgcttcagagagctttgcctcgcctccgcctgcgctcccctccagggtccttctgctggctgcggactcggcccaccactgctgtctgacgcttttcttcctgccccctctgaggcctggctctgttttagggagatcactgggcccaggcctcagccccagttctacctggcttgctgtcaccgctctaggggtgggggacgtcccaggggatccccaggagaaggagagccctgtagggggctgtgcagatgtgggtgtgccacagggagggtggcccctagccatgtatccattggctgttttggcttcagattcaaccaagatctgcctgactaaaagaagccacctcagcgcagtggaacggggcccagggggaggcaggagaggagggttccggtcccatgtcaccttctcatttgctgtgtgactttggcccactcacattctctttgggcctcagttttatcatttatacaaggagggcttttctagctgtaacaatctgtgaggattgagaggataggctggtgctttgaagaaaggccttgtaagtgacaagacagtcccctgggaagaaagagaaaggaaatgggctattgccaaaggacaggtggcgttagatggctgtgagggtgacctggtgagggaagggttggaatgagctgctgcaggaggccaagggatgcctgggctgggctgggctgggctggcttaggctcaggattgcctggggacagtaggagcatggcaggagctggggcaggtgcatagcagtgcagtgggaagggacagaggagatcttagaattttgaggaaaatctgggacttgagacctggattctaacagaccaactgcatgtgtgtctgtaggtctcagtttccacattcatacagtgagggtgttaagtcaggtagctggagacttcccatcgcctctgacacttttggaggtgatatgatacagcccccgaccaaaccaggctttgtggggggtgagagaatacagacacaagtggcaggattcagatggaagcttcgcaaggctgggggccgaggaccacccacttctctttcccagccctagttctgggttccccagtggggcaaggggtggtggaggcagtgcccatgctgggctgagcctgcagtttttgtgagctctgggcttgtctccatgggaacaggggtgccttcttagtgagctcatttcacacagatcgagggggtatgcgtgggggagttgtgagtgagctcagctccttcaggcctggcctctcccagaacagagtgaagcccctgccctggacccctgctcccttctacccttgagggccaccaatggaagagcccgcccttcattctgcagctcctgcggccaggctgagctctgcccccaactttgttttctctcatgttctcaatacactctgcctcaaa

SEQ ID NO: 30611 - DNA, 5098 bp, Homo sapiens
agtttgcatcttaggtcacaccactcctgtgattcctgtggtattgccccaaagcggcctcacaccagagacgggttaagaagagggattggaggtccaccactccactagcccaggaaggacttatctttcgtctcagccagacctcaccccaattctgtgaatcagcggaggaaggcaaaagtgcagagagtcagaggaggctgtgtaaggagcagagaccagggctcacacagctggccccagcccaggccctggcccaggcccaggagcctgcttccctgcatcgctgaggaagaacagcaccatgctgggtcctcacctcccacctccgccccttgcacccagcgaagggaggcctaccccctgcgccttccagatccctgatggaagctacaggtgtctggctctggaagccgaggagagcagcggtgaggagggcctgcagggagaggtggggcctaccgacctggaagaggatgagggggtcagcaggagtggggacgactctgcctgcagagtcacccaggggacaccgcagctgcccaaagccctgggcatccaaccacccagctgctccagagaggaacaaggggcgtcccagcacgacgacagggccagccaggactgggatgtagtgaaggccgggcagatgatgacagccagccccagccctggccctgggcccagagtggcccagaaaccagcgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggtgtggaagccttccttctgcttcaagtaacgaaccccacgggggtcccactgccggtcaagttcccctccttgagggccagatggagagcagatgtggcaggaaatggcacagagctgagtgaggagaatggggagtccatggttcaaggtcagatgcggccaccagctggctttgtgaccttgggcgagtcgcctcccctctctgagctgaagccgcccctcccctactacaacaggggtcggactccatgtctgagcggggaggagggtcatggagagagaactgtctggcagccctgatgcggtagaggggcatcctctggcctttgtgagctgtagggatgcagagtctgatgccagcgtcttgctgggggagtggcctagaaggggatcctaacagggacttctggagcagacagagcctgccagtgcctgtggagtcagccagccgagggtctgcctcctcagctgccccaggggggcctccctcctgaggctcaagctcctggcgtctttcttcctgttgctggattctcacctccatgggcctgtctcttctgcctctgccttctggacaccgtttcctctccgctgcttcagagagctttgcctcgcctccgcctgcgctcccctccagggtccttctgctggctgcggactcggcccaccactgctgtctgacgcttttcttcctgccccctctgaggcctggctctgttttagggagatcactgggcccaggcctcagccccagttctacctggcttgctgtcaccgctctaggggtgggggacgtcccaggggatccccaggagaaggagagccctgtagggggctgtgcagatgtgggtgtgccacagggagggtggcccctagccatgtatccattggctgttttggcttcagattcaaccaagatctgcctgactaaaagaagccacctcagcgcagtggaacggggcccagggggaggcaggagaggagggttccggtcccatgtcaccttctcatttgctgtgtgactttggcccactcacattctctttgggcctcagttttatcatttatacaaggagggcttttctagctgtaacaatctgtgaggattgagaggataggctggtgctttgaagaaaggccttgtaagtgacaagacagtcccctgggaagaaagagaaaggaaatgggctattgccaaaggacaggtggcgttagatggctgtgagggtgacctggtgagggaagggttggaatgagctgctgcaggaggccaagggatgcctgggctgggctgggctgggctggcttaggctcaggattgcctggggacagtaggagcatggcaggagctggggcaggtgcatagcagtgcagtgggaagggacagaggagatcttagaattttgaggaaaatctgggacttgagacctggattctaacagaccaactgcatgtgtgtctgtaggtctcagtttccacattcatacagtgagggtgttaagtcaggtagctggagacttcccatcgcctctgacacttttggaggtgatatgatacagcccccgaccaaaccaggctttgtggggggtgagagaatacagacacaagtggcaggattcagatggaagcttcgcaaggctgggggccgaggaccacccacttctctttcccagccctagttctgggttccccagtggggcaaggggtggtggaggcagtgcccatgctgggctgagcctgcagtttttgtgagctctgggcttgtctccatgggaacaggggtgccttcttagtgagctcatttcacacagatcgagggggtatgcgtgggggagttgtgagtgagctcagctccttcaggcctggcctctcccagaacagagtgaagcccctgccctggacccctgctcccttctacccttgagggccaccaatggaagagcccgcccttcattctgcagctcctgcggccaggctgagctctgcccccaactttgttttctctcatgttctcaatacactctgcctc

SEQ ID NO: 30612 - DNA, 2344 bp, Homo sapiens
aagtgagcaggcgcgcgggctcggcgcgcgcaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttcttttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaactaa

SEQ ID NO: 30613 - DNA, 2148 bp, Homo sapiens
cgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttcttttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaac

SEQ ID NO: 30614 - DNA, 477 bp, Homo sapiens
atggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaa

SEQ ID NO: 30615 - DNA, 2053 bp, Homo sapiens
atctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgaggtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctatgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 30616 - DNA, 2050 bp, Homo sapiens
tttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgaggtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctatgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 30617 - DNA, 492 bp, Homo sapiens
gggtaaatacaagtattggtgcacttagggtgcggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaa

SEQ ID NO: 30618 - DNA, 4283 bp, Homo sapiens
acctgcgcgcgacgcgcggaaggagttcgcgcgacgaccgcggggtcggcgggcggggcgaggccctggacggcggcggcagtggggctcctccttctgtttcccagaccgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacagattgaaagaagctataagtacaagtaaagaacaggaagcaaagtaccaggccagccacccaaaccttagaaagctggatgatacagaccctgtccccagaggggctggttctgccatgagtactgatgcttacccaaagaacccacaccttcgagcctatcaccagaagatcgacagcaacctagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcagacttccacttgcctaatgagattagtgattcaactgacttgaagcacagtaacatcttattttatgcacattccctgtcttttgctggactgatgaagccagtcacccgcccttctctgttttttggttttttttttcttaaccccaggtatatggaaggggagttgccttcacttttctggaaatttgtcttcgtctgacatattagagggcctcgttttgtcctgttcttgttcagaccctctcgttctacgtcctgtgctgaggggactgtccgtaagctacaggacagcgagctggtcctttctgccacttcttccccactcccatgcccaggaaggcctggttgctgatgctactttataaatgagttgcttgcattttcacagagaatgaaggaagacgtaacatggctccagaaacttttcacatgatgattgggatcgacaaaaaaatgctaccctctagactagacacatttcatggagacaagcaaaatggtgccagggctgggctgactgtgggatgggatttggtactgcagacagattttgatttccacagttgagctggaaacaaactgtgccttcaaaaaatgacttttctaacttaaggttggttatatgttaagtgtgctactaacttaaaaaatagtggctgggcgcggtggctcatgcctgtaatcccagtgctttgggaggccaaggcggggggatcacgaggtcaggagatcgagaccatcctggctaacacggtgaaaccccatctctactaaaaacacacaaaaaattagctgggcgtggtggtgggcgcctgtagtcccagctactcaggaggctgaggcaggagaatggcatgaacctgggaggcagagcttgcagtgagccgagacagcgccattgcactccagcctgggcaacagagcaagactccgtctcaaaaaaaaaaaaaaaaaaaaaatagtgcactctctggctggtcacggtggctcacgcctgtaatctcagcactttggaaggccaaggcaggcggatcacgaggtcagaagatcgagaccatcctggctaacacagtgaaaccccgtctctactaaaaatataaaaaattagtcgggcatggtggcgggcgcctgtagtcccaactactcgggagactgaggcagaagaatggcgtgaactcaggaggcggagcttgcagtgagccaaggcgacagagcaagactctgtctcaaaaaataaaaaatagtgcactgtccttcgagaaagttttctaacatctagtaatttgtaacttagaagtggagttgccttgtggatgtcttttttgcattctgtaggaaatgaaacgtgaatttaactcgggttgcaagaaataaaaatgtcagtgcatttaaa

SEQ ID NO: 30619 - DNA, 4808 bp, Homo sapiens
caatcaggatgctggggctcggagatgatgggcggccgcctcctcactggagggattcctggagaagctgcagtgtggggatgctctagaccgagtactgcccccagtgtctttccacctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccacgtgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccggtccgccctccagggaaaacgggaaaactagcaagagctagcaagaactagcaagagcttgaacaaacgcctggactcagattggaagactgctcatttgtctactgcctcattcctggaaattgcactggaactgtctgattaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggccctcaaggatgatgatgctgaaactggattgacagatggagaagaaaaagaagaacccaaagaagaggagaaactgggaaaacttcagtattcactggattatgatttccaaaataaccagctgctggtagggatcattcaggctgccgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagagcaagagaaattgggtgatatctgcttctcccttcgctacgtacctactgctggtaagctgactgttgtcattctggaggcaaagaacctgaagaagatggatgtgggtggcttatccgatccttatgtgaagattcatctgatgcagaatggtaagaggctgaagaagaaaaagacaacaattaaaaagaacacacttaacccctactacaatgagtcattcagctttgaagtaccttttgaacaaatccagaaagtgcaggtggtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaagaaaaacaaaaacaaaaaccaacaacaattagccatagttctgaatgcacttcaattaagccaaaacagacagctagtgatctttttatatgctctttttacttaagttttaatttgtcctttaaaaaaaggtgaaacaaaccaagaacaagttctagaaaactgaagcaacctcttatgtatactagatgcttgatttaggaggagtttttaaacgttttcaatgttattatgtagtaaatgacactattatgaagctactagtcattccataagagtcttaaaggactgctctgtgtaacactgtgactgccgtgtgtgcttagacccgtagtttcctcagtggatagcactcaatttattccgtagtgatattgtaacaatactgccattcccttctactgcactgcccaaggtgtgtgtagcacaaacagttctcattacaaaggaccaattcagaactgaaaagctatgcataggacaaggaagatacatagaatggggtggaacacagcattttgtcaagcactgtgcaatattccatatttttccccactatggtagacaaccatttcgtggaagggcagcctattatcccacactgcatctagccttttgtcccattcacttctgtgatccattttaatttccaggccacaagacagtagtgatgctctgaaatgaaagtttgtcttcacaaatatcaaaacaaaatggaggaaaactaagcattggcctcatgttcagtcttcaggatatcacaccacgtcttttcaaaaactaaagagaattcaaaaagggctgatggtaggctttgaacatggggttggctgtttcccagtaaaactggaattcctgtcgttactgtttccttatcaaagaaggggcaagctcttttgccttttaggccagacatagcaaacgctttataattggcatagacataaaggataaaaggaaaataaccgtctgccgatggtccgtacttcttaaaaaacataggtaatagaaaatatacacaagtcagaatgtgaaattaaataatggtttgaacagaaaattcaaacaagactctttccaatttaaagggccaaaccctaccaaagagagggagttgactggcttttaaaaagtatttaaataccacaaatgacatttaatttcactgtattcagctttaagttgttcacaatgaaaccacactttcaaacaagcaggttcaagctgctgaatagacattatttcttgcattaaaataccactaatgcattctcttgcaacactgccagacatgggattgtcaccatagaattagttggtactatgccatctttcactctttcacaagtcagtgatggaacctgctttatgaccaagattcatcctcaaataagccacatgtacccttctgacaaagctgtgtaaagtattagaatctgatgctctagaaagatcctagttgcctttgtgtatatttactgcctgcttgagtgtttctatgtgtgggttttccctgtatcttgtagaaatgttggggtgttttcctctgccatatggctcgtggcctgcgagccaactatttcagctgtattttaccttcatttttgatgaggtgatttaaattttgtttcactttgtgtagtgaattccacagtagttttctgattgttgttaaaaatgacttaacatattacacagatattcaataaaaatgttttatttcctgtt

SEQ ID NO: 30620 - DNA, 3095 bp, Homo sapiens
atctcggctccaccgcacccttcgcgggaagtccccaggcttccagcaaagctcagcttatcccgcccccgcttccaacccggaaccccagaagaacagcatgatgagcctccggcagccaggtgggccacctccccgcggctcagtttgaggacacttgtgcggaaccctttcacatccccaccctacccagctttcacaactccgccgggttaaatggccaaagacaaacttctacctctcctgtccccggtcccagcttttcaaaaacccacagctggcgaacccacacacatcgaaactcctaggtcgctgttgcagtctgggcatgctcagtatcagggctgcccctccaagagcggaggcagcgagagtacgcgtgtgcctcgcgccggtccacgcggggagagcactggggaccgagacccggcaccacctcccggtccgccctccagggaaaacgggaaaactagcaagagctagcaagaactagcaagagcttgaacaaacgcctggactcagattggaagactgctcatttgtctactgcctcattcctggaaattgcactggaactgtctgattaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggccctcaaggatgatgatgctgaaactggattgacagatggagaagaaaaagaagaacccaaagaagaggagaaactgggaaaacttcagtattcactggattatgatttccaaaataaccagctgctggtagggatcattcaggctgccgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagagcaagagaaattgggtgatatctgcttctcccttcgctacgtacctactgctggtaagctgactgttgtcattctggaggcaaagaacctgaagaagatggatgtgggtggcttatccgatccttatgtgaagattcatctgatgcagaatggtaagaggctgaagaagaaaaagacaacaattaaaaagaacacacttaacccctactacaatgagtcattcagctttgaagtaccttttgaacaaatccagaaagtgcaggtggtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaag

SEQ ID NO: 30621 - DNA, 762 bp, Homo sapiens
agatgccatgagaactcttaaaaacagagtaacatacttattataagacctattttaaatatttcattctttcctcattttcatgatacctaaattttttgaagactgaaaatgatgagaacttatataaaaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggccctcaaggatgatgatgctgaaactggattgacagatggagaagaaaaagaagaacccaaagaagaggagaaactgggaaaacttcagtattcactggattatgatttccaaaataaccagctgctggtagggatcattcaggctgccgaactgcccgccttggacatggggggcacatctgatccttacgt

SEQ ID NO: 30622 - DNA, 506 bp, Homo sapiens
attttggaggaatctttggcattctgaatcatcctcctataacactttcccatccaggccccacccaactaatttttaatcataatttagatctcaacacaaaggctggcacaaagggaaaacgggaaaactagcaagagctagcaagaactagcaagagcttgaacaaacgcctggactcagattggaagactgctcatttgtctactgcctcattcctggaaattgcactggaactgtctgattaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccg

SEQ ID NO: 30623 - DNA, 710 bp, Homo sapiens
aacagaagatgtcagaatgatatgaaaaagttgctcttttgaaatgtttgttcttctagatttttttaaaatgtcagcatgattcatacctattggttcttagcctggagcacccagcacaaccaggaattgaggaagctagagcaggatgtgaataacgaatgggctgcataagcagaagtctatacccagtcaataagcagaagtctatacccagtcagtgtgcagagttgcaggctagcattttcacagattctattattctctctctctcaagggaaaacgggaaaactagcaagagctagcaagaactagcaagagcttgaacaaacgcctggactcagattggaagactgctcatttgtctactgcctcattcctggaaattgcactggaactgtctgattaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcc

SEQ ID NO: 30624 - DNA, 579 bp, Homo sapiens
ctctctctctcaagggaaaacgggaaaactagcaagagctagcaagaactagcaagagcttgaacaaacgcctggactcagattggaagactgctcatttgtctactgcctcattcctggaaattgcactggaactgtctgattaagcctcctttcactccgtgcccaattcctgcagttgttgctgaggtttaccagatggattaaaagaaaaaataagaagtggctccaaacataaaaacagaataattctgaaagaaagaaaacaaagaaaaacatactccagaattcctaatagaacaatacagaaactgaggtacacagagccatttaccccaggtcaacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcct

SEQ ID NO: 30625 - DNA, 702 bp, Homo sapiens
tttaaagaaagatgacggtgtcttaggaatgcttttaagggttctttggttgaaagtctgggaatactcagagataatattaatgagagcctagagtttttttcttttaaaatggggttccatggctttgggcagaaatgatttttatatgtatcatgattgaaaaaactctcagtacaagatgatgcacttctttatacagggaaaacgggaaaactagcaagagctagcaagaactagcaagagcttgaacaaacgcctggactcagattggaagactgctcatttgtctactgcctcattcctggaaattgcactggaactgtctgattaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaagga

SEQ ID NO: 30626 - DNA, 2718 bp, Homo sapiens
atcttggctcctccctgattctaccaccaagaataaaatagttgtttgtcccctacagtagaacaagtttgcccattcatccttgtgatagatatgcatgcaaaaccaaaatgaaatcaaatccccacagatggctcgtaagtcaaaaacactgtttaattctttcactgcatccctttgggaagcctggcccttgaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggccctcaaggatgatgatgctgaaactggattgacagatggagaagaaaaagaagaacccaaagaagaggagaaactgggaaaacttcagtattcactggattatgatttccaaaataaccagctgctggtagggatcattcaggctgccgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagagcaagagaaattgggtgatatctgcttctcccttcgctacgtacctactgctggtaagctgactgttgtcattctggaggcaaagaacctgaagaagatggatgtgggtggcttatccgatccttatgtgaagattcatctgatgcagaatggtaagaggctgaagaagaaaaagacaacaattaaaaagaacacacttaacccctactacaatgagtcattcagctttgaagtaccttttgaacaaatccagaaagtgcaggtggtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaagaaaaacaaaaacaaa

SEQ ID NO: 30627 - DNA, 2913 bp, Homo sapiens
actctatgtctcctctcgttggattgtgacaccgggaggtcagggaactccaggaccttgttctctgctggattcgcagcaaccagcacagcacgtagggcgtagttggtgctggatggatgtttgttgaatgaatgaatgatgaatggctggcaccttgtctgctcatccctaactcctgttccttcatctgtgcagccctaatctttgtttcctcatctgtccatccctttatttgtgcatcctcattcttagccccttcactgcccttctccatctcttcctccttgttcatttgtccctgttctctgtcctctactccactcatgcccatctctgtccccttgacttacccagtccctgctactatctccatccctaatttctgccctcttgtctgtctactcctaattccttttccttgtccatccctaatacctgtcaccttgtccttcttcctcgaatctccatccctaatccatctgcccctaatctctgtcccctttgcccatccttccttttctcggtgtctctttccacccttatctccacacctgcccaccctgcactcccattctgtttcccatctgcacccttgccccatccctcccacacacaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcggccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtagactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacacccctgcgtctggccggtccccccactgctgctgctatcaacgccagaataaacacactctgtgggtctcactcc

SEQ ID NO: 30628 - DNA, 2838 bp, Homo sapiens
gaggcggcggcggcggcggctcctcgcccagccccgccccggcccctagatcagacattctctctcattacccggcgcgtgggaacgggtccacagccccttgtccgccctagaacccccatgggctgccgcccgccgccgcctcggctgccacccaggacacggcagagataagcgcagccccttcactgcccttctccatctcttcctccttgttcatttgtccctgttctctgtcctctactccactcatgcccatctctgtccccttgacttacccagtccctgctactatctccatccctaatttctgccctcttgtctgtctactcctaattccttttccttgtccatccctaatacctgtcaccttgtccttcttcctcgaatctccatccctaatccatctgcccctaatctctgtcccctttgcccatccttccttttctcggtgtctctttccacccttatctccacacctgcccaccctgcactcccattctgtttcccatctgcacccttgccccatccctcccacacacaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcggccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtagactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacacccctgcgtctggccggtccccccactgctgctgctatcaacgccagaataaacacactctgtgggtctcactcc

SEQ ID NO: 30629 - DNA, 2836 bp, Homo sapiens
ggcggcggcggcggcagcggcggcagcggcggctccggcccctagatcagacattctctctcattacccggcgcgtgggaacgggtccacagccccttgtccgccctagaacccccatgggctgccgcccgccgccgcctcggctgccacccaggacacggcagagataagcgcagccccttcactgcccttctccatctcttcctccttgttcatttgtccctgttctctgtcctctactccactcatgcccatctctgtccccttgacttacccagtccctgctactatctccatccctaatttctgccctcttgtctgtctactcctaattccttttccttgtccatccctaatacctgtcaccttgtccttcttcctcgaatctccatccctaatccatctgcccctaatctctgtcccctttgcccatccttccttttctcggtgtctctttccacccttatctccacacctgcccaccctgcactcccattctgtttcccatctgcacccttgccccatccctcccacacacaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcggccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtagactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacacccctgcgtctggccggtccccccactgctgctgctatcaacgccagaataaacacactctgtgggtctcactccaa

SEQ ID NO: 30630 - DNA, 2463 bp, Homo sapiens
ggcggcagcggcggcagcggcggctccggcccctagatcagacattctctctcattacccggcgcgtgggaacgggtccacagccccttgtccgccctagaacccccatgggctgccgcccgccgccgcctcggctgccacccaggacacggcagagataagcgcaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcggccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtagactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacacccctgcgtctggccggtccccccactgctgctgctatcaacgccagaataaacacactctgtgggtctcactccaa

SEQ ID NO: 30631 - DNA, 4094 bp, Homo sapiens
gatgagcatgtgttgaatcctcaagagaggagggaggaagcaagaaggaaagcttgaagggaggaggggaggggggcaggtgctgatttcagccctgtagcgtcaggattgcgtcaattcgggttccagccacgtctggagtctcggagacgagcttctcagaagagccaaaacaggaaccgaggtggcaaatcactgtgcgagggcgagtggacctccctctttgcctcctccctgttccaggagctggtgccctgggctctgcgctgttgttttcagcgctccgaaagccggcgcttgagatccaggcaagtgaatccagccaggcagttttcccttcagcacctcggacagaacacgcagtaaaaaatggctccgatcaccaccagccgggaagaatttgatgaaatccccacagtggtggggatcttcagtgcatttggcctggtcttcacagtctctctctttgcatggatctgctgtcagagaaaatcatccaagtctaacaagactcctccatacaagtttgtgcatgtgcttaagggagttgatatttaccctgaaaacctaaatagcaaaaagaagtttggagcagatgataaaaatgaagtaaagaataagccagctgtgccaaagaattcattgcatctggatcttgaaaagagagatctcaatggcaattttcccaaaaccaacctcaaacctggcagtccttctgatctggagaatgcaaccccgaagctctttttagaaggggaaaaagagtcagtttcccctgagagtttaaagtccagcacttcccttacttcagaagagaaacaagagaagctgggaactctcttcttctccttagaatacaacttcgagagaaaagcatttgtggtcaatatcaaggaagcccgtggcttgccagccatggatgagcagtcgatgacctctgacccatatatcaaaatgacgatcctcccagagaagaagcataaagtgaaaactagagtgctgagaaaaaccttggatccagcttttgatgagacctttacattctatgggataccctacacccaaatccaagaattggccttgcacttcacaattttgagttttgacaggttttcaagagatgatatcattggggaagttctaattcctctctcgggaattgaattatctgaaggaaaaatgttaatgaatagagagatcatcaagagaaatgttaggaagtcttcaggacggggtgagttactgatctctctctgctatcagtccaccacaaacactctaactgtggttgtcttaaaagctcgacatctgcctaaatctgatgtgtccggactttcagatccctatgtcaaagtgaacctgtaccatgccaaaaagagaatctccaagaagaagactcatgtgaagaaatgcacccccaatgcagtgttcaatgagctgtttgtctttgatattccttgtgagggccttgaagatataagtgttgaatttttggttttggattctgaaagggggtcccgaaatgaggtaatcgggcagttagtcttgggtgcagcagcagaaggaactggtggagagcactggaaagagatctgtgactaccccaggagacaaattgccaagtggcacgtgctctgtgatggttagcatcctagccgtgagttggaacttaaaggtttttactaggcaaggagaaattttctttctttctatattggattgcaagcttgggaaatcaagctacctttttgttgttgttgttgttgctagaaatggattgaattagtagaccagaaagtaacttcaaatgtgtattatgataatttccctatttattagaagagttggataaattttcataagatattcaatatctccttcagattaccagtgatataactaggaatagtcagacattttatgaatactgtgccagaatcccaaattataaatgtgacaatctcattggaacatgtcacaaaaagttaatgtgattaagatttaaaaacgaaaagtatgccttgccttgtgaaaatttatccatttatcttcaggttggggaaatcaatttttctttaaatccaaagatactaaaaaaatgtcctccagtttgtatttattaattctgtcatgtgcaaatggttgtcctgcatataaaagtatctggtcatttcagtttggtttgtaattatttgatgcaattttatcataagagtaactcagattcatttcaaaaggacagtgaacaagctgagaaattattttatcaaagggctgagttgagaacactgtggctgaaatataatttttctcccccctaaggttacatgtgagtcaaaattttgtaaaatataacctcacataagaaccatggccttggattattcactgcctgtcacaagcctcagtgtggcctgagaaatccctatgtacctttgtgaaattgttgaattagttagtgaataaagaaataaacttcaactagaaatccagttagaagtgcaattttcttataggaaataggtatagtgtgcaagtgtacttttaaggccatcgtttgtacccagagtcggcatggccacctaagtcttcatttaatttattgtcccccagaaaagattaagatgctacttgaaaagactgtgaagattttttacattgccagataaaaagtgttacttaaccaacaaacaaatgtaagactacaaaatcgttcaagagcaattctaatataatttacatatgttcacgcaaaatatgcttaggctgtcaaattagcacaacaaagaatgtgtttcactatcttttctaggctaatttgtcttgagctgttgtctatagagcagtttacagacttgtgtcttgtatcattttccagtgccagggttctgaaattcattcagaacctgttagattaaagctgcaccctgtgattatttgaaaagaattagcttgagagtaatgtcactatatttgagttcttagagaagtatgagtggaacttgagtacagttgaattattaaatatgcaagttagaaattaagtctactgaaaaatttacattttgagtcaggttttgtgtcagtactttagcagtttttgagaatgtgtttgatatcacagtgtttgtaaattctatgaaaaatgcattttccaaacaacttatacatgctttttatgactatgcctaatgtaaagaaaatgtattacattctgtatgtacaaagattaaaaatcaacctcttttttgtgctttaaaatgactttgggattaaaaaagcatatttcccaatcattgtcttcattccactacaaagtcacctcacagcatcttgctccactcggcatctctgtgaaagcaacatgaaatgaactgtagtaggtgtgtagtttggggaagtcaaatggccattttatgtatgtgcatttggtatcatgggccgtggaacagaatatatgttggacctctgaaaagttgtaaggggccaattctaagtattcttcacggcagccagaagttaatggtggtagcagctgaggtatggttgttggacgaggccgatttttttttttttaacatggaacaatgaaaccaacaacaaacatttttaaaattaaaatggataatttgtaaatagtttttagcttttaaaatttaaagtgtttttgagtgtgaaaagttgagtaaaactatttgcaactggttttcagaaaagagaaaagaaacaacaaaggaattgaaacaggcagggagatcttaatacctaatttcatcatttctgaaaatgtactgttttagaatgtattacaatatcaatgtgaatatcttgaatcctgttacaaatcctgcactgtattaaacatgtaaattaattgtttgtctgattagccaatctcaccacccaaatggggaggtatacatgtttgaagaactgtgtaactcagtaattgatttgttctgatgttgtaactcaatagaagtgttttggaaggaagcatggtgtgtgagacagtgtctgttcttttgtgccagctctgtatgatgtttgtaagaccatgtttgtaagacatgaataaattgctgcttttgccc

SEQ ID NO: 30632 - DNA, 1513 bp, Homo sapiens
ttcagcgctccgaaagccggcgcttgagatccaggcaagtgaatccagccaggcagttttcccttcagcacctcggacagaacacgcagtaaaaaatggctccgatcaccaccagccgggaagaatttgatgaaatccccacagtggtggggatcttcagtgcatttggcctggtcttcacagtctctctctttgcatggatctgctgtcagagaagaagcataaagtgaaaactagagtgctgagaaaaaccttggatccagcttttgatgagacctttacattctatgggataccctacacccaaatccaagaattggccttgcacttcacaattttgagttttgacaggttttcaagagatgatatcattggggaagttctaattcctctctcgggaattgaattatctgaaggaaaaatgttaatgaatagagagatcatcaagagaaatgttaggaagtcttcaggacggggtgagttactgatctctctctgctatcagtccaccacaaacactctaactgtggttgtcttaaaagctcgacatctgcctaaatctgatgtgtccggactttcagatccctatgtcaaagtgaacctgtaccatgccaaaaagagaatctccaagaagaagactcatgtgaagaaatgcacccccaatgcagtgttcaatgagctgtttgtctttgatattccttgtgagggccttgaagatataagtgttgaatttttggttttggattctgaaagggggtcccgaaatgaggtaatcgggcagttagtcttgggtgcagcagcagaaggaactggtggagagcactggaaagagatctgtgactaccccaggagacaaattgccaagtggcacgtgctctgtgatggttagcatcctagccgtgagttggaacttaaaggtttttactaggcaaggagaaattttctttctttctatattggattgcaagcttgggaaatcaagctacctttttgttgttgttgttgttgctagaaatggattgaattagtagaccagaaagtaacttcaaatgtgtattatgataatttccctatttattagaagagttggataaattttcataagatattcaatatctccttcagattaccagtgatataactaggaatagtcagacattttatgaatactgtgccagaatcccaaattataaatgtgacaatctcattggaacatgtcacaaaaagttaatgtgattaagatttaaaaacgaaaagtatgccttgccttgtgaaaatttatccatttatcttcaggttggggaaatcaatttttctttaaatccaaagatactaaaaaaatgtcctccagtttgtatttattaattctgtcatgtgcaaatggttgtcctgcatataaaagtatctggtcatttcagtttggtttgtaattatttgatgcaattttatcataagagtaactcagattcatttcaaaaggacagtgaacaagctgagaaattattttatcaaa

SEQ ID NO: 30633 - DNA, 3955 bp, Homo sapiens
cggagggaccgggcgggagagagagaaagcctgaccgaccggctggcgaagagctgcatgcaaccggtgggaggccgggccggctgggtctggggctcgggctcaggctcgcaccgtttctcggcaggtccctggcggtgagcgcggacggcccggaggcggcggctctgagctggcaggcggagggctgtctcctgcgcccgcctgcccggcgcggtccgaggatgcgggggggcgatgcccggggccagggacgcgctctgtcaccaggcgctgcagctgctggccgagctctgtgcccgtggggccctggagcacgacagctgccaggatttcatttaccacctgcgggaccgtgccagaccccggctccgcgacccagatatctcagtgagcctgctgacccttgtggtcactgcctgtggtctcgctctctttggcgtgtctctcttcgtatcttggaaactctgctgggttccgtggcgagaacgaggcctgccctctggtagcaaagacaacaaccaggagccccttaactacatggacacagagaccaatgagcaggagaacagtgaggacttcctagatcctcccacgccctgccctgactcctccatgaagatcagccacacctcccctgacattcccctctccacccagacggggatccaggagaactgtgcccatggcgtccgcgtgcagcgccaagtcacagagccaacctcgtcggcccggcataattcaatccgaagacaactcaacttgtcaaacccggacttcaatatccagcagcttcaaaaacaggaacagttgactggaattggtagaattaaaccagagttatataagcagaggtcattggataatgatgacgggagacggagtaacagcaaggcttgtgggaaactgaacttcattttaaaatatgactgtgacttagagcagctcatagtgaagattcacaaagctgtcaatttgcccgccaaggacttttctgggacttcagatccttatgtcaagatctatttgcttcctgatcggaaaacaaaacaccagactaaagttcacagaaagaccctgaaccctgtgtttgatgaagtgtttttatttccggttccctacaatgaccttgaagcacggaagcttcacttctctgtgtacgactttgacaggttctctcgtcatgacttaatcggccaagtggtggtggatcacttcctagacttggctgatttccccagggagtgcatcctttggaaggatatcgaatatgtcaccaatgacaacgtggatctgggagagctgatgttttccctgtgctatcttccaacggctggcaggctgaccattaccattataaaagcaaggaatttaaaggcaatggacataacaggagcatcagatccctatgtgaaagtctcgctgatgtgtgatggcagacgactgaagaagaggaaaacatccaccaagaggaacaccttgaatcctgtttacaacgaagccatagtctttgatgtccctcccgagaacattgaccaaatccacttgtccatagcagtcatggactatgaccgtgtaggtcacaatgagatcatcggcgtgtgtcaagtaggcaacgaggctgagaggctgggcagagaccactggagtgaaatgttgtcatatcctcggaagcccattgcacactggcattccctggtggagaaacgatgaccatgggtaagaggactgcttgtgccaaggacaaaataggacaaccatctcacaaagatcttaagtaactttttccatccagcaacatccagacgatttcagtgaccaaatgctcagctgtaaccacagcactaactggccttctttccagattgggtttggtgaacctgaatggtccagccaccttctgcaggtggcccaaggtgatgtgctgcagggaagcatgtctctcatgccaagaaccaagatcggactatgaacaaaaacaaatgatagatatagtgacagtaccaagagtaccaggactcaatgtttcatatgaagcccttggtgatgaggacatagcatctgccctggaaatcgttattccaacataatattattttctagaatgccctggaaggacagaatatttaaaaatatatccaggtgctaaataggcagcagatctcaattcacacatgactacctttgagctaatgactgtctccagaaaataactgtgccccaagaagtgctccagatttgcaaggaatagccccaagagaataccaagacaagcaggctgttccctggaaaaaatctaatgcaaggagggctagttcacagcaaattcactgcctcctcccatgcacgtggtagagagtaccagtatcaacatggccctgttttctgctaaaaccagattttgaggaatcagagacccccaacactactcactcagtagctagcagccccttcctttcaactgggagtgttattagaatgaaaagtaattagttagaagggcatacatctcagtggcatgagcattgtggaatatcctttcctaggcacattcgtccactaagggaacagcctcagaaactggtacagcaatgggtgagatgagatcatggagagagaacacagccatcccctatagaaaggcacagcttttgggcttctctggcctgaatgccttctggggtatttccatatgcaacagcccagagtcatagccttgggcaaccacacatagaggtttccttctcacttcagacacatacatcactttcacaccacttggggatggaaatacctacaagagtgaaggtcaagggccctccccaggcatctcattcattactcagcttccttcctgaccaagtctgccaaccaatggccagctatgcgcctcatcctcattgcttctgcctccacgtaaatgaaaccaaaggcctcagcatatcctgggaggactgggggctgttacctaatggtcctctctgtcccattataggtgcaaggcaccccatccacacatttgcaccactactccaagatagtatttttcttttcacacaatctctttacagcagaatccagagttggattgtagtttaccttcctggaaagctcattatctctgtttgaattaacatttcagcatggaactaactgggcggaggaaggatcgttatacgtcttcagaaagttctcattgccccagctgcctagtactatacaagaagctctactttgatggcagatctaagaaggctataggcctttgtttgtaggaagcagtgtcattacattcaagcttcacttctctgattggcttccaaccactgggattcaaagagaatccaaggttctgcctatgtctgatgacataaggaaaacttggcttcctctgctcaaggttcccctctgctcatccctcctcattcagacatcctccaccataccagtgtttagaagcaaaacatgaagggctagcgccaccaggatagttagcagaaatattgtctgtaaagctaggcagatgagcccagaagaatggtcccagagaaagcagactggctccaatagatatcaggcagcaatcccaataaattctgacatgtccttggcaatggaagcctgggttggagatcctgaggcagctgtgcctactgttccccacctcagaagcttcctgcccagagagccagcagccttgggatactaatgaggatgcaactggcttattggtatgaaatagaaggtggctttgtaggggcaagcaggcaaagagtactatccacatggcaggcaggtggctttgtgtctggaaagctttgcctagccagtacagctgtgagcagaggctggttataaatttgaactccctcagcccatttgcaactctgcctctgttctcttgcattctgtttggttgccctttagtttcctagtaaatgctccttttgaaaaa

SEQ ID NO: 30634 - DNA, 960 bp, Homo sapiens
atgctggcgaaggtggtggagggagatttagctttcaaaggaggcagagatatctcagtgagcctgctgacccttgtggtcactgcctgtggtctcgctctctttggcgtgtctctcttcgtatcttggaaactctgctgggttccgtggcgagaacgaggcctgccctctggtagcaaagacaacaaccaggagccccttaactacatggacacagagaccaatgagcaggagaacagtgaggacttcctagatcctcccacgccctgccctgactcctccatgaagatcagccacacctcccctgacattcccctctccacccagacggggatccaggagaactgtgcccatggcgtccgcgtgcagcgccaagtcacagagccaacctcgtcggcccggcataattcaatccgaagacaactcaacttgtcaaacccggacttcaatatccagcagcttcaaaaacaggaacagttgactggaattggtagaattaaaccagagttatataagcagaggtcattggataatgatgacgggagacggagtaacagcaaggcttgtgggaaactgaacttcattttaaaatatgactgtgacttagagcagctcatagtgaagattcacaaagctgtcaatttgcccgccaaggacttttctgggacttcagatccttatgtcaagatctatttgcttcctgatcggaaaacaaaacaccagactaaagttcacagaaagaccctgaaccctgtgtttgatgaagtgtttttatttccggttccctacaatgaccttgaagcacggaagcttcacttctctgtgtacgactttgacaggttctctcgtcatgacttaatcggccaagtggtggtggatcacttcctagacttggctgatttccccagggagtgcatcctttggaaggatatcgaatatgtcaccaatattcttagctag

SEQ ID NO: 30635 - DNA, 1825 bp, Homo sapiens
tttccgcctacccgagaccaaatacgggcacacacaatacacaccacacacgcgcgcacacgcacacgggcacacacgcgcgcacgggatcctgctccgctccgcggctcccccgccccggagagctccgcgatcagcacccgggacagcgccaccgcccacgtgcagggggtggggtccgggcggggctggcgcctcggcgtctcccgggagtgtcccgtccagccgccgagcagggtgcttgagtgtctctgcagaaaagactccaggaccccgccaccatgttcccggagcccccaaccccggggcctccatcgcccgacacgcctcccgactccagtcgcatcagccacggcccagtgcccccctgggccctggccaccatcgtgctggtctcaggcctcctcatcttcagctgctgtttctgtctctaccggaagagctgtcggaggcggacaggcaagaagagccaggcccaagcccaggtccaccttcaggaagtgaaggggctgggccagagttacatagacaaggtgcagccagaagtagaggagctggagccagcaccatccgggccagggcagcaggtggcagacaagcatgagctaggacgactgcagtactccctggattatgacttccagagtggccagctgctggtgggcattctgcaagcaatgggattggcagccttggatcttggtggctcctcggacccctatgtgcgggtctacctgctgccggacaaacggaggcggtacgagaccaaggtgcatcggcagacgctgaaccctcactttggggagaccttcgccttcaaggtcccctacgtggagctggggggcagggtgctggtcatggcggtgtacgacttcgaccgcttctctcgcaatgacgccatcggggaggtgcgggtccctatgagctccgtggacctggggcggccagtgcaggcctggcgggagctgcaggcggctccgcgggaggagcaggagaagcttggggacatctgcttctccctccgctatgtccccacggccgggaagctcaccgtcatcgtcctggaggctaaaaacctgaagaagatggacgtaggaggactgtcagatccatacgtcaaggtccacctgctgcagggcggcaaaaaggtgcggaagaagaaaaccaccatcaagaagaacactctgaacccctattacaacgaagctttcagcttcgaggtgccctgtgaccaagtccagaaggtgcaggtggagctgaccgtgctggactacgacaagctgggcaagaacgaggccatcgggagggtggccgtgggggcggccgccggcggggctggcctgcggcactgggcggacatgctggccaacccgcggcggcccattgcccagtggcactcgctgcggcccccggaccgagtgaggctgctgcctgcgccctgactcccaccccaagcccccggccaagcctggactctagcccctgaccccagactcccgagaccggccaaagccaagccagccccacccttaagcttcctctgacggttaccctccccccaccttccaccccaaccatctgaaccattcctgtcttctcacccccaacgatgccaatcacgacaactttccagcacactcccccgaccctcgcggacacacccagatgccccagggaccccgggaagggaaggcagcctggtttctcctgcccccgggtcctgccccctgctttgacaatcagccatcctcgtctgctctcctctctcttccaacacagcccatccctgcactgctcctggggccaaataaatattcagcagctc

SEQ ID NO: 30636 - DNA, 2612 bp, Homo sapiens
gggacccccgccctcagcccatccgcatccgcatccctagaggaaaggggtgtgcgagtgggggctggggcactggggagacaaccagagggagggcagcagcctgaagcggagagacagggatctggggacgcgagacaggtatggagaagacaaagagccgagggcggggagtggggcgcaggcggaggggagagggagagaccctggagacagaggccaggcgatagggaagagagacaggcgggttggggaggcagacacagggaagacgcctatgtggggtcaagaggcagcgtggagaccgaggcggtcacgagagcagcacggatgcgtggagagaccaacaggccaagaaggatgagggggctcagcacaggcaccgggcagcccccgacccgccctccagcaaaattggggagagggaagagggaacctgcgtctcagctcccaggaccaggtgcggagggagcagtcggctgtgggcgctcggaccacaggctgcccgctccccacctcgcgggacctcaggatcccagtcgggctattggggggttcccaggcaccggtgggccccggagcgagcctgccccgccgggactccgcgtctgtgcgtcagccccgcccgttgtcctggcaacaacccgttgcccgggcaaccagctttgctctcaccccgcttgagaggagcccggctgttgctctgggcaacgcggtctgctggttcccacgtctgccttcgcccgcttccggttcagaccctgcggaggggcgaggacgaggcagaagtcagcgggatgcctgtggggccgtggaggaagagggtatccctttaggatggaactaggtcctggacaccccctctcaagtgcggggaggctgatactacaactcccagcatgactcgcggtggctgtccggtttctgcgcggctgttcgcgcaaaggcctcatgggagttggagttctttgttgtgcgtggggctcaaaggacgtctggggtgggaatgggggactagggtgcttgagtgtctctgcagaaaagactccaggaccccgccaccatgttcccggagcccccaaccccggggcctccatcgcccgacacgcctcccgactccagtcgcatcagccacggcccagtgcccccctgggccctggccaccatcgtgctggtctcaggcctcctcatcttcagctgctgtttctgtctctaccggaagagctgtcggaggcggacaggcaagaagagccaggcccaagcccaggtccaccttcaggaagtgaaggggctgggccagagttacatagacaaggtgcagccagaagtagaggagctggagccagcaccatccgggccagggcagcaggtggcagacaagcatgagctaggacgactgcagtactccctggattatgacttccagagtggccagctgctggtgggcattctgcaagcaatgggattggcagccttggatcttggtggctcctcggacccctatgtgcgggtctacctgctgccggacaaacggaggcggtacgagaccaaggtgcatcggcagacgctgaaccctcactttggggagaccttcgccttcaaggtcccctacgtggagctggggggcagggtgctggtcatggcggtgtacgacttcgaccgcttctctcgcaatgacgccatcggggaggtgcgggtccctatgagctccgtggacctggggcggccagtgcaggcctggcgggagctgcaggcggctccgcgggaggagcaggagaagcttggggacatctgcttctccctccgctatgtccccacggccgggaagctcaccgtcatcgtcctggaggctaaaaacctgaagaagatggacgtaggaggactgtcagatccatacgtcaaggtccacctgctgcagggcggcaaaaaggtgcggaagaagaaaaccaccatcaagaagaacactctgaacccctattacaacgaagctttcagcttcgaggtgccctgtgaccaagtccagaaggtgcaggtggagctgaccgtgctggactacgacaagctgggcaagaacgaggccatcgggagggtggccgtgggggcggccgccggcggggctggcctgcggcactgggcggacatgctggccaacccgcggcggcccattgcccagtggcactcgctgcggcccccggaccgagtgaggctgctgcctgcgccctgactcccaccccaagcccccggccaagcctggactctagcccctgaccccagactcccgagaccggccaaagccaagccagccccacccttaagcttcctctgacggttaccctccccccaccttccaccccaaccatctgaaccattcctgtcttctcacccccaacgatgccaatcacgacaactttccagcacactcccccgaccctcgcggacacacccagatgccccagggaccccgggaagggaaggcagcctggtttctcctgcccccgggtcctgccccctgctttgacaatcagccatcctcgtctgctctcctctctcttccaacacagcccatccctgcactgctcctggggccaaataaatattcagcagctccggtg

SEQ ID NO: 30637 - DNA, 1671 bp, Homo sapiens
ggtctgctggttcccacgtctgccttcgcccgcttccggttcagaccctgcggaggggcgaggacgaggcagaagtcagcgggatgcctgtggggccgtggaggaagagggtatccctttaggatggaactaggtcctggacaccccctctcaagtgcggggaggctgatactacaactcccagcatgactcgcggtggctgtccggtttctgcgcggctgttcgcgcaaaggcctcatgggagttggagttctttgttgtgcgtggggctcaaaggacgtctggggtgggaatgggggactagggtgcttgagtgtctctgcagaaaagactccaggaccccgccaccatgttcccggagcccccaaccccggggcctccatcgcccgacacgcctcccgactccagtcgcatcagccacggcccaggtgcagccagaagtagaggagctggagccagcaccatccgggccagggcagcaggtggcagacaagcatgagctaggacgactgcagtactccctggattatgacttccagagtggccagctgctggtgggcattctgcaagcaatgggattggcagccttggatcttggtggctcctcggacccctatgtgcgggtctacctgctgccggacaaacggaggcggtacgagaccaaggtgcatcggcagacgctgaaccctcactttggggagaccttcgccttcaaggtcccctacgtggagctggggggcagggtgctggtcatggcggtgtacgacttcgaccgcttctctcgcaatgacgccatcggggaggtgcgggtccctatgagctccgtggacctggggcggccagtgcaggcctggcgggagctgcaggcggctccgcgggaggaggagaagcttggggacatctgcttctccctccgctatgtccccacggccgggaagctcaccgtcatcgtcctggaggctaaaaacctgaagaagatggacgtaggaggactgtcagatccatacgtcaaggtccacctgctgcagggcggcaaaaaggtgcggaagaagaaaaccaccatcaagaagaacactctgaacccctattacaacgaagctttcagcttcgaggtgccctgtgaccaagtccagaaggtgcaggtggagctgaccgtgctggactacgacaagctgggcaagaacgaggccatcgggagggtggccgtgggggcggccgccggcggggctggcctgcggcactgggcggacatgctggccaacccgcggcggcccattgcccagtggcactcgctgcggcccccggaccgagtgaggctgctgcctgcgccctgactcccaccccaagcccccggccaagcctggactctagcccctgaccccagactcccgagaccggccaaagccaagccagccccacccttaagcttcctctgacggttaccctccccccaccttccaccccaaccatctgaaccattcctgtcttctcacccccaacgatgccaatcacgacaactttccagcacactcccccgaccctcgcggacacacccagatgccccagggaccccgggaagggaaggcagcctggtttctcctgcccccgggtcctgccccctgctttgacaatcagccatcctcgtctgctctcctctctcttccaacacag

SEQ ID NO: 30638 - DNA, 1705 bp, Homo sapiens
ggggaccctgcggggaagtgattaaaagcagagcggagccgcagggggccgctgcagggagggtcttcttggggccgtcgtgccccgccccagtgcggccggggcgcgggttcgagctgctgctcggcaagcctgggtgtctagggcatgagcggagtgtggggggccggcgggcctcggtgccaggaggcgctcgcggtcctcgcctcgctgtgccgggcccggccgccccctctcgggctggacgtggagacttgtcggagcttcgagctgcagcccccagagcggagtcccagcgcggcaggcgcaggcacctctgtcagcctcctcgcagttgtagttattgtgtgtggcgtggccctggtggcagtttttctctttctcttttggaagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccaggcacacgtccttcaagcgccacctgccaaggcagatgcatgtctccagtgtagactatggcaatgagcttccaccagcagcagagcagcccaccagcattggccgcatcaagcctgagctctacaagcagaagtcggtggatggggaggatgccaagtctgaggccaccaagagctgcgggaagatcaacttcagcctacgctacgattacgagaccgagaccctgattgtgcgtatcctgaaggcttttgacctccctgccaaggacttttgtggaagctctgacccttatgtcaagatctacctcctgcctgaccgcaaatgcaagctgcagacccgggtgcaccgcaagaccctgaaccccacctttgatgagaacttccacttccctgtgccctatgaggagctggctgaccgcaagctgcatctcagtgtcttcgactttgaccgcttctcccgccatgacatgattggcgaggtcatcctggacaacctctttgaggcctctgacctgtctcgggaaacctccatctggaaggatatccaatatgccacaagtgaaagcgtggacttgggagagatcatgttctccctttgctacctgcccactgcaggcaggctcaccctcacagtgattaagtgtcggaacctcaaggcgatggacatcacaggctattcagatccctatgtgaaagtgtccttgctctgtgatgggcggaggctgaagaagaagaaaacaaccataaagaaaaacactctcaatcctgtctacaatgaggccatcatctttgacattcccccggaaaacatggatcaagtcagcctgctcatctcagtcatggactatgatcgagtgggccacaatgagatcataggagtctgtcgtgtggggatcactgctgaaggcctgggcagggaccactggaacgagatgctggcatacccccggaagcccatcgcacactggcactccttggtggaggtaaagaaatccttcaaagagggaaaccctcggttgtgatttcattcacgtggatgctgcaagc

SEQ ID NO: 30639 - DNA, 3133 bp, Homo sapiens
aaggaccaggacgccggggttccaggagactctgcaggctccatccctccttattcccccaccccgaccccagtagcgctgggcctaggagcactcgggagttgctcagtggctctgcaccgctggcgcgggaaggggagaaaggggctgccagaggcgggaatttggtccccacgcgctgctccagggacgagaagccagggaccggcggttctgggagcagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccaggcacacgtccttcaagcgccacctgccaaggcagatgcatgtctccagtgtagactatggcaatgagcttccaccagcagcagagcagcccaccagcattggccgcatcaagcctgagctctacaagcagaagtcggtggatggggaggatgccaagtctgaggccaccaagagctgcgggaagatcaacttcagcctacgctacgattacgagaccgagaccctgattgtgcgtatcctgaaggcttttgacctccctgccaaggacttttgtggaagctctgacccttatgtcaagatctacctcctgcctgaccgcaaatgcaagctgcagacccgggtgcaccgcaagaccctgaaccccacctttgatgagaacttccacttccctgtgccctatgaggagctggctgaccgcaagctgcatctcagtgtcttcgactttgaccgcttctcccgccatgacatgattggcgaggtcatcctggacaacctctttgaggcctctgacctgtctcgggaaacctccatctggaaggatatccaatatgccacaagtgaaagcgtggacttgggagagatcatgttctccctttgctacctgcccactgcaggcaggctcaccctcacagtgattaagtgtcggaacctcaaggcgatggacatcacaggctattcagatccctatgtgaaagtgtccttgctctgtgatgggcggaggctgaagaagaagaaaacaaccataaagaaaaacactctcaatcctgtctacaatgaggccatcatctttgacattcccccggaaaacatggatcaagtcagcctgctcatctcagtcatggactatgatcgagtgggccacaatgagatcataggagtctgtcgtgtggggatcactgctgaaggcctgggcagggaccactggaacgagatgctggcatacccccggaagcccatcgcacactggcactccttggtggaggtaaagaaatccttcaaagagggaaaccctcggttgtgatttcattcacgtggatgctgcaagcagagagactgccacctggagttaggatggcagggccgagctgctagcttcgacagtgagagctcgtgcccatctccgaaaccacctccaacaccatgagatgtgcagccaaataacacaaatgggactcagcaatgttctctttgcacttgttcaaccgtctaaacagtgttgtgcagtcgcagtggcggcagcagcggcagccgtccgtcactccagagtcttacctgctcctgtgtaggtcaaagctgagacacttgtcatgtggtcagatctgtcttagtcttttgtgtctcccaaggtgatgtttttgtggtttttcactttttatgggtctgctggtaagaaaagggaaaaaaaaaaagagtaggaaaagacaaagggtggaaagcccagaagttggttctagaaaatacaaggtacagttttttggaaagaggtggattgagtttctgaaatgctgcgtctccagcaagctccacaaccctggaaaaggaggaggcgtggtgggactgcggctgcattttcagtgccctgcaggaatggggtgaatccatggaagagcctttgtgaggtgaattactagtctttgaagctcttcgctggcaggacataaaccacgctgggaccctcagtcccgtgttgaaatcacaagacctctgaggcgcttgtgagccttcagctgatgtgcagggttcctcgctccccttcctcgctggctttccccatgaattgaaaacgtcttgattcctcatgggaacttagtcactttctttaggaatgattcagttcagccgaaactaaacacgccatatgttttctgatgcgccacagttaatgatcacatttgtttgaaaacaggatctttgtcctcagaaataatcttgattgtaaagtaagagagaaacatatgttctggaatgatttctgcattatacatagctttataattccatgaagtatcaagctgctgtttaaaatgcctaaacagattaaagaaaaacctagattaaatgttcttttccaaatggggagttttgaaatccaaatagcagtttgagtccatctttctatgaagagtatgtttttgattgaaaccgagtcagcgtaagcctatttcagcccctttggctctttgacaatattcatcttaaactttagttctataaattactaagtacttcagtgttgtttgtttcagtggttgtgagggtttcttgtttcctttagatctttaccttaggccaaactcagtttaggaaaaaaaaaattgtttgaactattctgtgttgtaatagcacatttctgttgagttaatagtggtcttcccaccaacccctaaaaccaggttgatttgctcaatctcagtttgtataaccccagtaagcgcatggaggtgagtttctacttcgacttgtggcgacacagtgccagtttcctgagctgtgtgtactacttgcaagaggcaagtctgctgaagaaccccttcttttaacagtggaaaatcaagaacagaaaatctgttcacacacctgtgtcttattctttatatatgctacatggtagaggagcagcgaccaataaagtatccctcatttt

SEQ ID NO: 30640 - DNA, 4370 bp, Homo sapiens
tggggccgtcgtgccccgccccagtgcggccggggcgcgggttcgagctgctgctcggcaagcctgggtgtctagggcatgagcggagtgtggggggccggcgggcctcggtgccaggaggcgctcgcggtcctcgcctcgctgtgccgggcccggccgccccctctcgggctggacgtggagacttgtcggagcttcgagctgcagcccccagagcggagtcccagcgcggcaggcgcagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccaggcacacgtccttcaagcgccacctgccaaggcagatgcatgtctccagtgtagactatggcaatgagcttccaccagcagcagagcagcccaccagcattggccgcatcaagcctgagctctacaagcagaagtcggtggatggggaggatgccaagtctgaggccaccaagagctgcgggaagatcaacttcagcctacgctacgattacgagaccgagaccctgattgtgcgtatcctgaaggcttttgacctccctgccaaggacttttgtggaagctctgacccttatgtcaagatctacctcctgcctgaccgcaaatgcaagctgcagacccgggtgcaccgcaagaccctgaaccccacctttgatgagaacttccacttccctgtgccctatgaggagctggctgaccgcaagctgcatctcagtgtcttcgactttgaccgcttctcccgccatgacatgattggcgaggtcatcctggacaacctctttgaggcctctgacctgtctcgggaaacctccatctggaaggatatccaatatgccacaagtgaaagcgtggacttgggagagatcatgttctccctttgctacctgcccactgcaggcaggctcaccctcacagtgattaagtgtcggaacctcaaggcgatggacatcacaggctattcagatccctatgtgaaagtgtccttgctctgtgatgggcggaggctgaagaagaagaaaacaaccataaagaaaaacactctcaatcctgtctacaatgaggccatcatctttgacattcccccggaaaacatggatcaagtcagcctgctcatctcagtcatggactatgatcgagtgggccacaatgagatcataggagtctgtcgtgtggggatcactgctgaaggcctgggcagggaccactggaacgagatgctggcatacccccggaagcccatcgcacactggcactccttggtggaggtaaagaaatccttcaaagagggaaaccctcggttgtgatttcattcacgtggatgctgcaagcagagagactgccacctggagttaggatggcagggccgagctgctagcttcgacagtgagagctcgtgcccatctccgaaaccacctccaacaccatgagatgtgcagccaaataacacaaatgggactcagcaatgttctctttgcacttgttcaaccgtctaaacagtgttgtgcagtcgcagtggcggcagcagcggcagccgtccgtcactccagagtcttacctgctcctgtgtaggtcaaagctgagacacttgtcatgtggtcagatctgtcttagtcttttgtgtctcccaaggtgatgtttttgtggtttttcactttttatgggtctgctggtaagaaaagggaaaaaaaaaaagagtaggaaaagacaaagggtggaaagcccagaagttggttctagaaaatacaaggtacagttttttggaaagaggtggattgagtttctgaaatgctgcgtctccagcaagctccacaaccctggaaaaggaggaggcgtggtgggactgcggctgcattttcagtgccctgcaggaatggggtgaatccatggaagagcctttgtgaggtgaattactagtctttgaagctcttcgctggcaggacataaaccacgctgggaccctcagtcccgtgttgaaatcacaagacctctgaggcgcttgtgagccttcagctgatgtgcagggttcctcgctccccttcctcgctggctttccccatgaattgaaaacgtcttgattcctcatgggaacttagtcactttctttaggaatgattcagttcagccgaaactaaacacgccatatgttttctgatgcgccacagttaatgatcacatttgtttgaaaacaggatctttgtcctcagaaataatcttgattgtaaagtaagagagaaacatatgttctggaatgatttctgcattatacatagctttataattccatgaagtatcaagctgctgtttaaaatgcctaaacagattaaagaaaaacctagattaaatgttcttttccaaatggggagttttgaaatccaaatagcagtttgagtccatctttctatgaagagtatgtttttgattgaaaccgagtcagcgtaagcctatttcagcccctttggctctttgacaatattcatcttaaactttagttctataaattactaagtacttcagtgttgtttgtttcagtggttgtgagggtttcttgtttcctttagatctttaccttaggccaaactcagtttaggaaaaaaaaaattgtttgaactattctgtgttgtaatagcacatttctgttgagttaatagtggtcttcccaccaacccctaaaaccaggttgatttgctcaatctcagtttgtataaccccagtaagcgcatggaggtgagtttctacttcgacttgtggcgacacagtgccagtttcctgagctgtgtgtactacttgcaagaggcaagtctgctgaagaaccccttcttttaacagtggaaaatcaagaacagaaaatctgttcacacacctgtgtcttattctttatatatgctacatggtagaggagcagcgaccaataaagtatccctcattttaaaccaagttgtcagatttctctgctgatagaacgctgcatagtatcttctagccctaaaaatgaccaggttgggcatgagttaacaggatattgtggcaaaaggaattttctgcttagaaaagtaaatgtagataaacctaaactccaccctgtactgagccttaggctagggactcatgtgtaaagatgacttttctccccagatatcttgtcattgacaggccttcctagtctggtagtcctacatttgggtgttctcctgagagtgagaaaaaacccaaggtcatgacaagattcctggcaggtgacagacttcattatgattctgactctagactgaccccatcaagatagtcgtttccgtcagtgaacagatgctgaaggccttgccattacaaaggagacaactgagttccctgggtcataaggagtccagaaattagtgtgagaaggtccttctggaagtgaactcaaaattcatgtccagctgtcatcgttaaacccttaggcaggtgagtataacccattctaacctcttggagaagggagtgtgatcaatgtgaatcacaatagtattgctcatctgagacattcctcttatatccaagcagctatctcccatgagtgaacatcccagtggtttcagaaaatcatgtcctgaacagattctagccagccccacaccaccctggccaactgcaaccgctgctgctctagcagtctgggtcaattcctacaggcttgggagcccaccccagggaggcttttatctcctgcagcctcatccccagcaccctcaaggtagactactcctcagcctgaatcatgaatgaaacctgaacatctgccaacttcattatctagcccagtatctcttccctcacagagaagaagaaaatgaaatacaaagttgatccatttgttggctttctctggccggagaaacctctcgggttgttgctgtgagctttgatgaagttgtgataaccagggccatttgcacataggtttttttaaaaaacatgaaaagttcccttctcctttatttagcagtgtttccgggctgaaagacgccctcctccccctctgcgcttacccaggacgttaattaattgcactgtcatttaaaatattatgttgttaattactcgtttgtgtcttcccacccgtgtcacagcctggagtttttattcaattaaatctctgtctcttgccca

SEQ ID NO: 30641 - DNA, 4453 bp, Homo sapiens
tggggccgtcgtgccccgccccagtgcggccggggcgcgggttcgagctgctgctcggcaagcctgggtgtctagggcatgagcggagtgtggggggccggcgggcctcggtgccaggaggcgctcgcggtcctcgcctcgctgtgccgggcccggccgccccctctcgggctggacgtggagacttgtcggagcttcgagctgcagcccccagagcggagtcccagcgcggcaggcgcaggcacctctgtcagcctcctcgcagttgtagttattgtgtgtggcgtggccctggtggcagtttttctctttctcttttggaagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccaggcacacgtccttcaagcgccacctgccaaggcagatgcatgtctccagtgtagactatggcaatgagcttccaccagcagcagagcagcccaccagcattggccgcatcaagcctgagctctacaagcagaagtcggtggatggggaggatgccaagtctgaggccaccaagagctgcgggaagatcaacttcagcctacgctacgattacgagaccgagaccctgattgtgcgtatcctgaaggcttttgacctccctgccaaggacttttgtggaagctctgacccttatgtcaagatctacctcctgcctgaccgcaaatgcaagctgcagacccgggtgcaccgcaagaccctgaaccccacctttgatgagaacttccacttccctgtgccctatgaggagctggctgaccgcaagctgcatctcagtgtcttcgactttgaccgcttctcccgccatgacatgattggcgaggtcatcctggacaacctctttgaggcctctgacctgtctcgggaaacctccatctggaaggatatccaatatgccacaagtgaaagcgtggacttgggagagatcatgttctccctttgctacctgcccactgcaggcaggctcaccctcacagtgattaagtgtcggaacctcaaggcgatggacatcacaggctattcagatccctatgtgaaagtgtccttgctctgtgatgggcggaggctgaagaagaagaaaacaaccataaagaaaaacactctcaatcctgtctacaatgaggccatcatctttgacattcccccggaaaacatggatcaagtcagcctgctcatctcagtcatggactatgatcgagtgggccacaatgagatcataggagtctgtcgtgtggggatcactgctgaaggcctgggcagggaccactggaacgagatgctggcatacccccggaagcccatcgcacactggcactccttggtggaggtaaagaaatccttcaaagagggaaaccctcggttgtgatttcattcacgtggatgctgcaagcagagagactgccacctggagttaggatggcagggccgagctgctagcttcgacagtgagagctcgtgcccatctccgaaaccacctccaacaccatgagatgtgcagccaaataacacaaatgggactcagcaatgttctctttgcacttgttcaaccgtctaaacagtgttgtgcagtcgcagtggcggcagcagcggcagccgtccgtcactccagagtcttacctgctcctgtgtaggtcaaagctgagacacttgtcatgtggtcagatctgtcttagtcttttgtgtctcccaaggtgatgtttttgtggtttttcactttttatgggtctgctggtaagaaaagggaaaaaaaaaaagagtaggaaaagacaaagggtggaaagcccagaagttggttctagaaaatacaaggtacagttttttggaaagaggtggattgagtttctgaaatgctgcgtctccagcaagctccacaaccctggaaaaggaggaggcgtggtgggactgcggctgcattttcagtgccctgcaggaatggggtgaatccatggaagagcctttgtgaggtgaattactagtctttgaagctcttcgctggcaggacataaaccacgctgggaccctcagtcccgtgttgaaatcacaagacctctgaggcgcttgtgagccttcagctgatgtgcagggttcctcgctccccttcctcgctggctttccccatgaattgaaaacgtcttgattcctcatgggaacttagtcactttctttaggaatgattcagttcagccgaaactaaacacgccatatgttttctgatgcgccacagttaatgatcacatttgtttgaaaacaggatctttgtcctcagaaataatcttgattgtaaagtaagagagaaacatatgttctggaatgatttctgcattatacatagctttataattccatgaagtatcaagctgctgtttaaaatgcctaaacagattaaagaaaaacctagattaaatgttcttttccaaatggggagttttgaaatccaaatagcagtttgagtccatctttctatgaagagtatgtttttgattgaaaccgagtcagcgtaagcctatttcagcccctttggctctttgacaatattcatcttaaactttagttctataaattactaagtacttcagtgttgtttgtttcagtggttgtgagggtttcttgtttcctttagatctttaccttaggccaaactcagtttaggaaaaaaaaaattgtttgaactattctgtgttgtaatagcacatttctgttgagttaatagtggtcttcccaccaacccctaaaaccaggttgatttgctcaatctcagtttgtataaccccagtaagcgcatggaggtgagtttctacttcgacttgtggcgacacagtgccagtttcctgagctgtgtgtactacttgcaagaggcaagtctgctgaagaaccccttcttttaacagtggaaaatcaagaacagaaaatctgttcacacacctgtgtcttattctttatatatgctacatggtagaggagcagcgaccaataaagtatccctcattttaaaccaagttgtcagatttctctgctgatagaacgctgcatagtatcttctagccctaaaaatgaccaggttgggcatgagttaacaggatattgtggcaaaaggaattttctgcttagaaaagtaaatgtagataaacctaaactccaccctgtactgagccttaggctagggactcatgtgtaaagatgacttttctccccagatatcttgtcattgacaggccttcctagtctggtagtcctacatttgggtgttctcctgagagtgagaaaaaacccaaggtcatgacaagattcctggcaggtgacagacttcattatgattctgactctagactgaccccatcaagatagtcgtttccgtcagtgaacagatgctgaaggccttgccattacaaaggagacaactgagttccctgggtcataaggagtccagaaattagtgtgagaaggtccttctggaagtgaactcaaaattcatgtccagctgtcatcgttaaacccttaggcaggtgagtataacccattctaacctcttggagaagggagtgtgatcaatgtgaatcacaatagtattgctcatctgagacattcctcttatatccaagcagctatctcccatgagtgaacatcccagtggtttcagaaaatcatgtcctgaacagattctagccagccccacaccaccctggccaactgcaaccgctgctgctctagcagtctgggtcaattcctacaggcttgggagcccaccccagggaggcttttatctcctgcagcctcatccccagcaccctcaaggtagactactcctcagcctgaatcatgaatgaaacctgaacatctgccaacttcattatctagcccagtatctcttccctcacagagaagaagaaaatgaaatacaaagttgatccatttgttggctttctctggccggagaaacctctcgggttgttgctgtgagctttgatgaagttgtgataaccagggccatttgcacataggtttttttaaaaaacatgaaaagttcccttctcctttatttagcagtgtttccgggctgaaagacgccctcctccccctctgcgcttacccaggacgttaattaattgcactgtcatttaaaatattatgttgttaattactcgtttgtgtcttcccacccgtgtcacagcctggagtttttattcaattaaatctctgtctcttgccca

SEQ ID NO: 30642 - DNA, 391 bp, Homo sapiens
cctgcccgatccgcgctgaccctgcgcgggacgcagccccaggcggctgcctagccgaggcgggagcccgagctgagtcgagctcgccggagcggctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccaggcacacgtccttcaagcgccacctgccaag

SEQ ID NO: 30643 - DNA, 565 bp, Homo sapiens
gtccttcccccaccccctctcgcccctataactcgctccctccgtccctctcggactcggactcggggccggtgcgcgactgagctggcgcctctagccgactttgccaagagggcgcctcctgcccgatccgcgctgaccctgcgcgggacgcagccccaggcggctgcctagccgaggcgggagcccgagctgagtcgagctcgccggagcgggcacctctgtcagcctcctcgcagttgtagttattgtgtgtggcgtggccctggtggcagtttttctctttctcttttggaagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccagg

SEQ ID NO: 30644 - DNA, 4854 bp, Homo sapiens
ccgggcgcgctcacacacgcgctcacacacacacatacacacggcctcgtacacacacacacgctccggcgcgcacacgcggcgcgcaggccggagggaggcggctcggcgctgttcggcggcggcggcagcgtgctccgcgggcgggcgggagggctggcgggcggcccccgctccccggctccgcggctaggtgcagcccgctcggcccccgccctcggacccgcccccgggggtcgcccggccccatgcccagcggcggcggcggagcagcgcgcggccgcgggcggctctgaggagcccggagggaaccggcgacgaggggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctgagtggggccaagggaggcccagggggccgagggcccaggtccccatcatgccctcaccactttatgcacaacgcccggcctgagccccctgccatagggaggggaggaccctgagggctcagccagggaggggtcccaggactcaactgggccccgtttctaggaagtaccagccccatcccccacagtccagctccggggaaggggctctgggaggcattttcctgctttgccccttttcttcctgacttactaatactaaagaagttgggggagctcgagagccagacggccagacaggcagacccctccagaggcccgccaggtgggcatggtcccccattttctttaaggcagcacctggagtggagagaggccactccctctccagcccccgatgtggacccggggaggggaggctgaggcgtttggccccggcctggccaggagaggcccatccccagggcagtttcaggtgccggctgggccctgaatgtcgaggatagtatatagcccgctcctgggtcctggagctgtggccctttgtactcgtgttgtgtccattgtgtgtgtgcgtggggacagaggcctggaaatgcggaggactatacagagaaggcaggttttgtgaaggccaggcagggttggaggccgggggtgtgagaggagaggcccatagggctgagtggggtcgggtgaggcagaggtcagaaacagaagagctgcagttgctggagctgggctgagaactgggctgcctcctgccatccccccgtctcctccccttctccccttggtgcccccctctgctcagaatctgaagtagttccctcctcagcaatttcatctcttgaacactgactcacaccttttaggcacctactgtgtgcatagcattccaccaggactcatctcccttccttctcagggggtcccgagccccgactagctttgccctaactccttcatcaaaagaccccccgccagcttcccacacctcatacgcagccacatctgccctattctccatgctttccagcttgcctgcccttcctcatctctccctgcctgtgcagacctccacccttctttcctccacccctccatcccccaatgcttgtagaccttccattcattccgtctcatcgtgcgtggtctctgatcgtccatcacctgaccttctccaggactgtcttctcacccttccccactccctggtccccgggagcagctccttctgcccgactcactcacagtgcagggaaaggaggcagggaaaagaccaggattctgtgagttctgaggttgccacacacaaagaagctgtggtttctctgcctcggccactgatgagactaaaactggcttccccttggagacggcagatttcaggctgatccctgcttaagccctctcatccccacgctggtcctggtattgatacaagacccagctggtgacaaagcctccaatcctgggggtccacgagcctgggcctgacattcccagaactaccgccaggtggcgccaggcccccacagtctgtggccgtggtcttagcccccagttccactctggatgggcctgtgacaccccaaagagaagaaggggactctggatagggtccccacatccagggcgtggggagaccattggcatttgggaaccattttccttcgaacggcttccccttgagctgagcattctgcttgctgcagtagacgggtcgccttttgcccataccgaaattttctgaaattaaatcgcacacccccaccatttcctctccctgggatctggaggaacatcatacatagtaggtgaatcgttttgtagagtgaagaatgctaatgtaaagcaaatagtcacccacgttccttgtaaatccaaatgtttctatattgtagctttgcttaaaatggggtcggccccaactgcatcctcctctttggcgggctggggagcggcccccagccgggacgggagggcagcgaccccgaggcctcgtggacgtgggagagagtgtggtgggaagtcttgagcggaggaggggatctgcccttctccactcctctcttggatccgcctcggtttcctgtccccccaccacccgcctgccccgcggaagaccgcccagtgagccagcccccaccttccaggcgccttcgccctggggatccaaccaacttgtatcgagtgggcggggcaacggctccccatttttcccgagccccgcccacagagctcttagccaatcctatgcagagagcatctcctggcaggggtctcttcccaaccagaccccacccaggcacattagcgaccaggcttgggcttccccagcgccccaccaccaccacgtgcaggtggagctctgggatgctatgttggggcggcaagcggtgggccgagggccgggtaggctagcacgggaggtaagggtggtatgggatggggcgggggcggtctagggcaataggagagcagagaatgggggaacttgagggtggggggagggcaccggagccttgccaccatcccaggactttgggcaagtcacccgcactccctgggcctcggtttccccatctgtaaaatgatggtaataatacttcacctacctcataggggaggttgtgaggccaccatcacctgacctgggggtcaaggcaggaggactccgaaggtgctacccgtgagcaaagtgtaattaccgaatcctgactgcaaggcccacctgcccctcccccacagagcctccagagctagctgaggccaacgcaggcccatccgtctcttcactctgtcgcaggccctttcatgggcttcgtctgccatctttgtgggtgccctagacttagtccttatcttgtcctggtttcctttcttgtgaccatctccccatgaaagtgctgtacaaattccacccgccccaggacccccgcacctgccctctggcaccagatgccagggaagggacagaggaaaacagccacaaacaagccaggggggctccccggagccccaggggtggggattggtggccactgtttgtatgttcttgagtgcaagtgttttataaaaaataaaacaaaaacccaccatcacaaaaaaaaaaattttgcagcgaagagaaatgaagaaaaactgaagaaaaaaaaaaaacaggaaaaaaagaaccatacaaaatttttccaccacacataccctctaagccagcaagatttcctctttgcaaaatcatatttttgtgggaatgggccctgctttttgtggcaaggcctgttctgattaataaaggatcgtgaaaaagta

SEQ ID NO: 30645 - DNA, 4534 bp, Homo sapiens
gaagttctagaaaatgttaattgggggagctgtggctggcagagaaggaaaaaggaagctgaagggcacttgggctcataatggtctctccaaccctgatcctgtcctttatggacatttggcagcgctgctgccttgaggtgccttgcaatgctttatctttttgttaaagccacctctgttgcttcagccagcttgagcggttttctgttacttgctagtggttgggaaggcttagccgacgaagggaaaatgagtcaggtcctgaaggatgagcaagttacgggagtgggccgcatggtgagggagtggacttcctgatggggttaagggcgcctgaacacctgggaggcaagttgaggccaagacctggggtgatggagaggcagggtaggctacccagtgagtaggaggccgaaggaaccacagcagggctccagatctcctggcccagaggggctggtacgggaagcccagaagacactcatccctaaggggagcctgagactgaggaactctcatgccctgcgtcgggctcgtgggcgaagggccttcccagggactgcaccatggcctgtccccagccttacccaggggcctccctctcaggttctgaaggacccaggggtcacagctgtgtggggtgctccactgaacacttccttcaaactccttcaggctggagtgcagtggcgcgatctcagctccatgggagagagtttgaaaggatgaagagtttacatcctctggaaagaagcaaatagaaggcattccaggcaaaaggaactgcatcgagtaaaagcatggaggcaagaaagggcttggtgtgtttgagaaacagtgagtagggcatggtggtggcagaagcttaaagtgtatggcccgtggacagtgacagccggacaagaagctgaagtgacagaacaagttgaaccaaaggaattccagacctgggaaagtggagaaagaattttggggtcagagccgtttaagactttgcctagggcctgggtcttctttctcctaaaggcctcaacccacagcacgccacacaaatatgtcacataacacacaaacaaacatcatatttcacagtccaggaaatgaaatgaagacaaaagcgccccctgtgggtgaagtcacagtcactgcagcagacatcatggctgtggatgtggcagaataccatctgagcgtcatcaagagcccccctggctgggaggtgggtgtctatgctgcaggggccctggccctgctgggaatcgcagctgtgagcctgtggaagctctggacgtcggggagcttccccagcccctctccgttccccaattacgactacaggtaccttcagcagaagtacggcgagagctgcgcagaggccagggagaagagagtgcctgcctggaatgcccagcgggccagcacgcggggaccacccagccgcaaaggcagtctcagcattgaggacacctttgagagcatcagtgaactggggcctctggagctgatgggccgggagttggacctggccccctatgggaccctccggaagtcccagtcggccgactccctgaactccatctcctccgtgagcaacacctttgggcaggacttcacactgggccaggtggaggtgagcatggagtacgacactgcctcccacacgctgaacgtggcggtgatgcagggcaaggacctcctggagcgggaggaggccagcttcgagtcctgcttcatgcgcgtcagcctgctgccggacgagcagatcgtgggcatttctcggatccagagaaatgcctactccatcttctttgatgagaagttctccatccccctggatcccacagccctggaggagaagagcctgcggttttctgtatttggcatcgatgaggatgagcgcaacgtcagcacgggggtggtggagctgaagctttctgtgcttgacctcccgctgcagcccttcagtggctggctctatttacaggaccagaacaaggccgccgatgctgtgggggagatcctgctctccctcagctacctccccacagccgagcgcctcaccgtggtcgtggttaaggccaagaacctcatctggaccaacgacaagaccacagcggaccccttcgtcaaggtgtacctgctgcaggatgggaggaagatgagcaaaaagaagacagccgtgaagagggatgaccccaacccggtgttcaacgaagccatgatcttctcggtgccagccattgtgctccaggacctgtctctccgcgtgacggtggctgagagcagcagcgacggccgtggggacaacgtgggccatgtcatcattgggccgtcagccagtggcatgggaaccacacattggaaccagatgttggccacgctgcgcaggcccgtgtccatgtggcacgctgtccggcgaaactagcaaccagggcgggccagttgggcaatggagctgctggagcccggtacccactcagctctgtctgatgccctctccatagcccagctggagccgtgaacactggggtcccctggcagagtcctcatgacccatcctggtctctctgtccagattgcagcagaggagtgggcgtggctctgtgtccagggccccagggtctgctcctgctgaggaccagctgtggctgggccaggacagaggactcaaccctgctcctcccggtaggccagctgccgagctgggctatgttctggaacccagtgaatcttgggggccaggcactgtgctaggcaccagcaggggtaacacgaagaagacccggcccttagggcatcaggaagactagctcccctgccccggaggatctgctcagtgctgatggcagcccagctgtgtggactcagggggctctgagggctagggaaacaggaagggcctctttgacaaggtaggagctgtgcttggaggggcaggaaaagaactgagcatgtcgcaggcagcgggcccagcctgagcaatggcaggatgtgaacttccccatcgcaaatgcagttctcagcccactgcagtggatacaaggaagggcctttctcggggccggagaagagaccaagagaccaggcccgggcagcagcctaccggccacgtggaacactggctccggagttattctctgtcaaatctactccccggacctcaaccatggcaagaaccagaggtccaaagaggcccagacccaggtccttgtgctcagtcctgcgcaaaccaggcccagaccctgcaagcatttgttgatgcccttgcaggcccactgggagaaagatgcctcaggcaggtctcagcctgggggtggcaggggtggggcagagagaatactgacagcagaggtcttggtgggctgcacgtgcctgcgaagatgtggtggacaaggaggctctcgggctgggccttggaggggtggcagcggaaggacagcccaggtggctgaggcctgatgggaagccggggaaggccagggtggaagggcggcttgagggacgccaggagaagactgaatgccaggctaggaaggaggcggctctcgatcacggggtgggtgcccccgacaccgggtctcctagcttgagttccctagaagcgaaatctgagagggggattctggggcaagtagtttcttgcgggtgagtgttctcagagaaacttaccagatcaagaaagggagctcaggctggatggaggaagccacgcaagtgtggcttcaagatccatcgccttggcctgatcgctgtgggggcaggggcctggagtacgaggggcaccctgggggctcccacccagaagcagaggggctgggctgttgcacctctactggcatcagtctttggttaccccccagccccagtaggaggagagcaggcagagcttgtcatccccagcctggtgtcccgcagtcccaggaagccgcttcttgccttcatggctgagtgctgggaagggctgagctcacccaggccagcaggtggggtatcatctgctcggtggggccacccacaggtgacagcatggaccctcaggctggctgcccctgttccttggtccataactggtgagctatggagacccaggccaacaaattatccccagtgatatggggggaggaggggctagaacaagggcccaggggactggaggcaggatggtggctttccctacctgacacagccatggcccagccccaaggccaggctgtctaccctatggccacagcaggaggtcagcccagggccaggagacacatggctggacaaggctttgcagcctgggagaccccgactttctctaacccagtggctgtgcggtgcaggccactgactccccccctgccctctcccctctctccctccccctaactgcatgacatgttaactgtgtgcccaggacagccgtggtggggaccgggtatgccaactggaatgattctagaaccaaaataaagttggggcaggaagagggggcttccagggagccctgctcggccctgaatcaccttcgtctcttctctaggaa

SEQ ID NO: 30646 - DNA, 1678 bp, Homo sapiens
atgtaaaaaatggagtcaccacgaccagattaggccacggtgaggactgagatgatgttgtaaggcaccagcacagagctgacctacagctcaatcgtggtgggagggagtaattatccattcagaaaaggggaaactttccgctgcgcctcctgtcgctgttttccttggctcccggaggtgcgcagtatcgggtccgtttttaagtcacagtcactgcagcagacatcatggctgtggatgtggcagaataccatctgagcgtcatcaagagcccccctggctgggaggtgggtgtctatgctgcaggggccctggccctgctgggaatcgcagctgtgagcctgtggaagctctggacgtcggggagcttccccagcccctctccgttccccaattacgactacaggtaccttcagcagaagtacggcgagagctgcgcagaggccagggagaagagagtgcctgcctggaatgcccagcgggccagcacgcggggaccacccagccgcaaaggcagtctcagcattgaggacacctttgagagcatcagtgaactggggcctctggagctgatgggccgggagttggacctggccccctatgggaccctccggaagtcccagtcggccgactccctgaactccatctcctccgtgagcaacacctttgggcaggacttcacactgggccaggtggaggtgagcatggagtacgacactgcctcccacacgctgaacgtggcggtgatgcagggcaaggacctcctggagcgggaggaggccagcttcgagtcctgcttcatgcgcgtcagcctgctgccggacgagcagatcgtgggcatttctcggatccagagaaatgcctactccatcttctttgatgagaagttctccatccccctggatcccacagccctggaggagaagagcctgcggttttctgtatttggcatcgatgaggatgagcgcaacgtcagcacgggggtggtggagctgaagctttctgtgcttgacctcccgctgcagcccttcagtggctggctctatttacaggaccagaacaaggccgccgatgctgtgggggagatcctgctctccctcagctacctccccacagccgagcgcctcaccgtggtcgtggttaaggccaagaacctcatctggaccaacgacaagaccacagcggaccccttcgtcaaggtgtacctgctgcaggatgggaggaagatgagcaaaaagaagacagccgtgaagagggatgaccccaacccggtgttcaacgaagccatgatcttctcggtgccagccattgtgctccaggacctgtctctccgcgtgacggtggctgagagcagcagcgacggccgtggggacaacgtgggccatgtcatcattgggccgtcagccagtggcatgggaaccacacattggaaccagatgttggccacgctgcgcaggcccgtgtccatgtggcacgctgtccggcgaaactagcaaccagggcgggccagttgggcaatggagctgctggagcccggtacccactcagctctgtctgatgccctctccatagcccagctggagccgtgaacactggggtcccctggcagagtcctcatgacccatcctggtctctctgtccagattgcagcagaggagtgggcgtggctctgtgt

SEQ ID NO: 30647 - DNA, 1661 bp, Homo sapiens
actgcaggggtggcgttgccgccggcggccgggctaggcgcaggtgcgtgcgcgctgcgggaggcgggccggcagctggagcccagccggagcggcggcccctccgcggagcccggtcacagtcactgcagcagacatcatggctgtggatgtggcagaataccatctgagcgtcatcaagagcccccctggctgggaggtgggtgtctatgctgcaggggccctggccctgctgggaatcgcagctgtgagcctgtggaagctctggacgtcggggagcttccccagcccctctccgttccccaattacgactacaggtaccttcagcagaagtacggcgagagctgcgcagaggccagggagaagagagtgcctgcctggaatgcccagcgggccagcacgcggggaccacccagccgcaaaggcagtctcagcattgaggacacctttgagagcatcagtgaactggggcctctggagctgatgggccgggagttggacctggccccctatgggaccctccggaagtcccagtcggccgactccctgaactccatctcctccgtgagcaacacctttgggcaggacttcacactgggccaggtggaggtgagcatggagtacgacactgcctcccacacgctgaacgtggcggtgatgcagggcaaggacctcctggagcgggaggaggccagcttcgagtcctgcttcatgcgcgtcagcctgctgccggacgagcagatcgtgggcatttctcggatccagagaaatgcctactccatcttctttgatgagaagttctccatccccctggatcccacagccctggaggagaagagcctgcggttttctgtatttggcatcgatgaggatgagcgcaacgtcagcacgggggtggtggagctgaagctttctgtgcttgacctcccgctgcagcccttcagtggctggctctatttacaggaccagaacaaggccgccgatgctgtgggggagatcctgctctccctcagctacctccccacagccgagcgcctcaccgtggtcgtggttaaggccaagaacctcatctggaccaacgacaagaccacagcggaccccttcgtcaaggtgtacctgctgcaggatgggaggaagatgagcaaaaagaagacagccgtgaagagggatgaccccaacccggtgttcaacgaagccatgatcttctcggtgccagccattgtgctccaggacctgtctctccgcgtgacggtggctgagagcagcagcgacggccgtggggacaacgtgggccatgtcatcattgggccgtcagccagtggcatgggaaccacacattggaaccagatgttggccacgctgcgcaggcccgtgtccatgtggcacgctgtccggcgaaactagcaaccagggcgggccagttgggcaatggagctgctggagcccggtacccactcagctctgtctgatgccctctccatagcccagctggagccgtgaacactggggtcccctggcagagtcctcatgacccatcctggtctctctgtccagattgcagcagaggagtgggcgtggctctgtgtccagggccccagggtctgctcctgctgaggaccagctgtggctgggccaggacagaggactcaaccctgctcct

SEQ ID NO: 30648 - DNA, 5144 bp, Homo sapiens
ggcggcgggagagctgctggctcgcccggatcccgggagctgcctggaggcgggcccggcccggggaaggtgagcggctgcgggacccagcccctcgccgggagcgggcaccatggtgctgtcggtgcctgtgatcgcgctgggcgccacgctgggcacagccaccagcatcctcgcgttgtgcggggtcacctgcctgtgtcggcacatgcaccccaagaaggggctgctgccgcgggaccaggaccccgacctggagaaggcgaagcccagcttgctcgggtctgcacaacagttcaatgttaaaaagtccacggaacctgttcagccccgtgccctcctcaagttcccagacatctatggacccaggccagctgtgacggctccagaggtcatcaactatgcagactattcactgaggtctacggaggagcccactgcacctgccagcccccaacccccgaatgacagtcgcctcaagaggcaggtcacagaggagctgttcatcctccctcagaatggtgtggtggaggatgtctgtgtcatggagacctggaacccagagaaggctgccagttggaaccaggcccccaaactccactactgcctggactatgactgtcagaaggcagaattgtttgtgactcgcctggaagctgtgaccagcaaccacgacggaggctgtgactgctacgtccaagggagtgtggccaataggaccggctctgtggaggctcagacagccctaaagaagcggcagctgcacaccacctgggaggagggcctggtgctccccctggcggaggaggagctccccacagccaccctgacgctgaccttgaggacctgcgaccgcttctcccgtcacagcgtggccggggagctccgcctgggcctggacgggacatctgtgcctctaggggctgcccagtggggcgagctgaagacttcagcgaaggagccatctgcaggagctggagaggtcctactatccatcagctacctcccggctgccaaccgcctcctggtggtgctgattaaagccaagaacctccactctaaccagtccaaggagctcctggggaaggatgtctctgtcaaggtgaccttgaagcaccaggctcggaagctgaagaagaagcagactaaacgagctaagcacaagatcaaccccgtgtggaacgagatgatcatgtttgagctgcctgacgacctgctgcaggcctccagtgtggagctggaagtgctgggccaggacgattcagggcagagctgtgcgcttggccactgcagcctgggcctgcacacctcgggctctgagcgcagccactgggaggagatgctcaaaaaccctcgccggcagattgccatgtggcaccagctgcacctgtaaccagctgcccagctgcctcccttcttggacagccctgacccgtcctctgcaacctcctttctgtgcccctttcctcattctgacacccagaagacagtgacagatgtgtttgcaaggctgggatggctctctcatcatactcttgtttcttagaaataagcaagacagagcaggaaatggaatatgcgggtcacactgaggaatgcattttgctcatctgtgttattgaaggaggtgcttattaaatacagttcctatgcctgttttataggtggggttaggccagatgcagagaaagctaaatgtgggaatcatggatgcaaagaagaatttggctttttgaaaaacaagcatttcaaaaatgatgaaggaagtgaaagtatcctggatcaactcctagagttagagattgcccaggtggaaagaaaccttagccagcgttcaatcaagctcaccatgcagggcagtcacccggcagttctcaaactttagcatgtgaagagtcaccagcagattcctgggctcgcctggagacattcctagtcggtattcctggtcgaagcccaggagccttcctttttaacaagctgatgtagagggtggagcactgtatgtggagaaattccttctacaatattccacacaggtttttggccacagtccttgatggagtcccaaaaccatggtgcagccagttccaatgctggacacctcaaccatcagggtgaaatctggggcctcagctttttaatttaattattttaattcttaatactttaatttgtgcatttcataagccccctgctcttggactgaattttgtgctttttattgaagaattttattgtttttatcttaaaatcagtttctattatccttggggagaccatccctaacaaagtacaggtgggatctcctgtgagtcattggctgggttctgattgctagatgtcacacccaccagcatcaccaaagtgactctgagatagaccggtcccttctcagcgttccagtcacttcaggaggaatttagttattgacttagtctatgacatctggctacatgtaggtagagaagaaagataattttaaaaaggaaatcaggtcttttgcaactgtgcctccctctgtctgttttcacttgaatgggtaaataaccagcagctaggttttgaattcctaccttgttattctaaacagatgtccacattgttaattaaatctaaattatgagccttgctgagtggatacggtacttacacctgaaccaggattcctgggttctgttgttgacattgcccttcagcacctgtttggccagctgtgtaagataggactaatgactaggaagcctaccccaatgaatgatatactagatgaaatagtgttcaaaacctgtaggcactctctggctaaaaacaaactctgaggccaccagcagatcatctttaagctaagttactatttttcacctttttttttagacggagttttgctctttgttgcccaggctggagtgcagtggcacgatctcggctcactgcaacctccgcctcccaagttcaagcgattctcctctctcagcctcctgggtagctgggattacaggtgcccaccaacatgcctggctaatttttgtacttttagtagagatggggtttcaccatgttggccaggctggtcttcaactccagatctcaggtgatctaccctcctcggcctcccaaagtactgggattacaggcctgagccaccgcgcccggcctatttttcactttaatttggcagctgagaatgcccagaaagtgccagaagcatcgtggcatttccagaaccatggattctgcctttggacccctctctattaatattaaaactctgggccttcagatgtcaccctaatccacttccctaagacagaatttctggacaagatgggtaagggcttcattccttcaacaagtcaagtcatacttggcctctccctgagaatctgagcaggagccttataacctgtggtcattattttttctttctgtacagaaatagaaaagcattagaaataacttctaaccatcctctgaaaaaacagaaaaaatatcgaatccctctttcatgagaagtcttttggataattggaaaccttcatcactgaggttggccagcccctgccaagtgttgtgtaggcaaagcacttgttagtggcttcctatgaaatgttttagagatctcttcaccatactggtttcttctctttggttggtgtgggtaaaagaaaacaaaacatttcctataagctgaaagctgaccagcattctcttcttggtaacatctactactccaatctagaaaatttggattctagaccaaaaatcaggaaacatggctccttataaatctgtgcagctgccttatagtaccatcaaaggaatttcaggtgggctgggcggggccccgatcccagaattatcaactccacccatcatcatttggtcatgaagcatcctttcattcttcttcttcttttttttgggggggcggggcgggggagggatctcaaagttttagtcttccagaatccaaattaaaggttgcccctgatgggggccaggttccgccacagaacatcttagatgtcagccttgacctcacttagcagggattacagaaatgagatacattttgaaggagagttgtctgttatgttcactgtattctaagtgcctgggataaagctgtctcatgggtgctccatatatattcatatatatttgttgagtgaattaatgaattaagagtggctggcagagtaggcagaaaaagacactgcaaatggcataaaaattaaagtcctagctgagttctcaatggtaaaggcatcagatgtcttagcagtcaagctagaaattcatgacaatgagtattactatttgcctaatggcaactcattgctctccatgtaaatgtaatcaacagatgaagagaatataattgctctgcttttccactaaaactccatcttagtgaattttaaattatccagagatgtcaaactgccaaataaaaatatttcagtagtctttgcatcagcttaccttgtaccagaaacatttccaatttactatcaaattatagtaactgagcctgtgtgaagtatctcatcattttcgaaaggaacaccttgtgtgatgccagtgagcatttctaaaaagggtgtgaggtagaggtaaaaataaggtgagagaccatttcagaatgcactgttgctcaaaaaggtgatctggttctttcttcagagatttctacggggatagaaaatcgggagtctgccctcattaatctgtgattccacctcttgcaccaaatcaatatctatttgttgagcacttattgattaagaccttgcatatgtctgtccattttgatttgagatacaactttttgtgtgggttgaatgacaaatcactccaaacaaagctgggcacagagaatcagctaggagaccagttattcagggtccatttctcttggatgtaaaggagtcctgggtaaaatgtggctgtaacctaaaccaactagtccttgtgatttgtttctgccctctgtgtttcctgttgtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacagggt

SEQ ID NO: 30649 - DNA, 5109 bp, Homo sapiens
gtggagagagaacctgtggagtacatgaacttatctgtattagaaaagaatctggaatctgagtgcatgctgatctcccattgacttctgttctattactgtaccccatcagagagatgtgaggagttggttgaaattcaaatcgggaacatatccaaagaccacaacatcctttgacaccaacaactgtctatgcttccttagaaggagccacctgacaactgggtggttcaacaaagtggccccaggaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcagaacagtgtcgcaagatctttatttcctctgaagtatgtaaaagttgtataatgtgctaactttttaatggcaaggcactttcatttgtttttatatttaggaactctaatcaggaatattataagctgttttctttttaattttgcttcttacctaatatatcattttatgcatatactttatcagagtatgttttatatatattaaaaatagtttcttttttctccttctcatttctagttaaaatagacaaaaacatactatttaccagttactaaaaagcagtatatcattgcttctagtcccaactaagtactatatattattgtaaactagaacttgttattaccataataacaaaacaatgcgtagatattacttcagcttggctgtactgaaaggccttaaaagaaacccaaaaagaccgtgaacttctgtatttttttagtttaaaaaatggcagctctatgcattcatacacatgaattataagaaaaaatacaaatgctatattggatgacatgaggtttgagaatgtgtgttacagggctgcattaaagggaaaaatccatcttttattgttacatcaatgagctttttccaggatttttcaaataaacaagtaagagttagaacctgaatcaaatggcaaaatatctcatttaagtgttttcagcaacagtatgaaaaaagacttgaagaggggatgtagattttactgagaaattggacttaggcatttgaagctataatgaactttttagactttgaaacaactgactgcattgctaacaactgttatcttcctaataaaaagagttatcagtcttatctgtaactgtaacagagcttagtgaaacacattagtaagaccagcttggtgctttcactcttagtgagaaaaagacctaactaattgttatttgttaaatctaccttttttcagactattcccagaattgtgtgtgtgatttgatacatccctagggatttatctggcataagtatcaaatccttcatggcttaaaaattaataaacagttttttaatatttctggaaagaccctacctccaccccagctgccaagtcctcaaagattataaattatctatatgagtgtatgtatctgtatacacacatgcaccattacacatacaacataaatatgtatatgtatattcatttgtaaaggcaaaggtgccctggctttttcagataactgaatagaaaaacatttcatacatttaggattatttttctcctctatgtatttactagatattatatttggtttgggttgctttctgctgctgttctccttcacacacagcaaaatatacatttgtttctgtagattgacacaacttataataattactcccaaaaagttgtctgttcttttagaaaaggattaaataaggctcaggggacccacttcactctactgaatctaatgtacgagacagtactactgcttctttgtgtgcttgaatttgcatgaaagcttaatagcaaaatcttctatctcagtaattatagcaaatagggacctactggtagggagcaggtgttggctcagaaacctgaaaaagacaacccactttcatacagttctattaaaatcccctaagttttctaataaaatgatatagtccaaatatggcaatcgactggcatttatgggagcctctaaacctggaattatggggtttatttttctcccaaatgagctgcaaaagataattattgctgcccagtaaacaaaatgtatgtcaaatcagtaaagaatttgtttagcataatattgccttatctttcagaagctttcttctatattcttgtgtcttcagtacaatccacttttgtttgaaatccatttgcatattatcttactgtgcatttagtgaattctcaataatgttgtatttgctgacaagaataataaattggaccacaattaaaaa

SEQ ID NO: 30650 - DNA, 2940 bp, Homo sapiens
ccatccagttggtgcggtccatggcgagcgcatcatggcgattgaaggtggagagagaacctgtggagtacatgaacttatctgtattagaaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatggactgttctgttgtctaaaacacttgataggtggacaggtttatataatccgagatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtga

SEQ ID NO: 30651 - DNA, 5043 bp, Homo sapiens
agcgcgtcctccgccagccctcgcgtctgctgcccccgccatccagttggtgcggtccatggcgagcgcatcatggcgattgaaggtggagagagaacctgtggagtacatgaacttatctgtattagaaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaagatggactgttctgttgtctaaaacacttgataggtggacaggtttatataatccgagatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcagaacagtgtcgcaagatctttatttcctctgaagtatgtaaaagttgtataatgtgctaactttttaatggcaaggcactttcatttgtttttatatttaggaactctaatcaggaatattataagctgttttctttttaattttgcttcttacctaatatatcattttatgcatatactttatcagagtatgttttatatatattaaaaatagtttcttttttctccttctcatttctagttaaaatagacaaaaacatactatttaccagttactaaaaagcagtatatcattgcttctagtcccaactaagtactatatattattgtaaactagaacttgttattaccataataacaaaacaatgcgtagatattacttcagcttggctgtactgaaaggccttaaaagaaacccaaaaagaccgtgaacttctgtatttttttagtttaaaaaatggcagctctatgcattcatacacatgaattataagaaaaaatacaaatgctatattggatgacatgaggtttgagaatgtgtgttacagggctgcattaaagggaaaaatccatcttttattgttacatcaatgagctttttccaggatttttcaaataaacaagtaagagttagaacctgaatcaaatggcaaaatatctcatttaagtgttttcagcaacagtatgaaaaaagacttgaagaggggatgtagattttactgagaaattggacttaggcatttgaagctataatgaactttttagactttgaaacaactgactgcattgctaacaactgttatcttcctaataaaaagagttatcagtcttatctgtaactgtaacagagcttagtgaaacacattagtaagaccagcttggtgctttcactcttagtgagaaaaagacctaactaattgttatttgttaaatctaccttttttcagactattcccagaattgtgtgtgtgatttgatacatccctagggatttatctggcataagtatcaaatccttcatggcttaaaaattaataaacagttttttaatatttctggaaagaccctacctccaccccagctgccaagtcctcaaagattataaattatctatatgagtgtatgtatctgtatacacacatgcaccattacacatacaacataaatatgtatatgtatattcatttgtaaaggcaaaggtgccctggctttttcagataactgaatagaaaaacatttcatacatttaggattatttttctcctctatgtatttactagatattatatttggtttgggttgctttctgctgctgttctccttcacacacagcaaaatatacatttgtttctgtagattgacacaacttataataattactcccaaaaagttgtctgttcttttagaaaaggattaaataaggctcaggggacccacttcactctactgaatctaatgtacgagacagtactactgcttctttgtgtgcttgaatttgcatgaaagcttaatagcaaaatcttctatctcagtaattatagcaaatagggacctactggtagggagcaggtgttggctcagaaacctgaaaaagacaacccactttcatacagttctattaaaatcccctaagttttctaataaaatgatatagtccaaatatggcaatcgactggcatttatgggagcctctaaacctggaattatggggtttatttttctcccaaatgagctgcaaaagataattattgctgcccagtaaacaaaatgtatgtcaaatcagtaaagaatttgtttagcataatattgccttatctttcagaagctttcttctatattcttgtgtcttcagtacaatccacttttgtttgaaatccatttgcatattatcttactgtgcatttagtgaattctcaataatgttgtatttgctgacaagaataataaattggaccacaatt

SEQ ID NO: 30652 - DNA, 5162 bp, Homo sapiens
agcgcgtcctccgccagccctcgcgtctgctgcccccgccatccagttggtgcggtccatggcgagcgcatcatggcgattgaaggtggagagagaacctgtggagtacatgaacttatctgtattagaaaagatagggtatttctctgtggccaggctggagtacagtggcaccatcttggctcactgcaacttccgcctcctgggttcaaacgattcttctgcctcagcatcccaagtaactgggactacagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatggactgttctgttgtctaaaacacttgataggtggacaggtttatataatccgagatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcagaacagtgtcgcaagatctttatttcctctgaagtatgtaaaagttgtataatgtgctaactttttaatggcaaggcactttcatttgtttttatatttaggaactctaatcaggaatattataagctgttttctttttaattttgcttcttacctaatatatcattttatgcatatactttatcagagtatgttttatatatattaaaaatagtttcttttttctccttctcatttctagttaaaatagacaaaaacatactatttaccagttactaaaaagcagtatatcattgcttctagtcccaactaagtactatatattattgtaaactagaacttgttattaccataataacaaaacaatgcgtagatattacttcagcttggctgtactgaaaggccttaaaagaaacccaaaaagaccgtgaacttctgtatttttttagtttaaaaaatggcagctctatgcattcatacacatgaattataagaaaaaatacaaatgctatattggatgacatgaggtttgagaatgtgtgttacagggctgcattaaagggaaaaatccatcttttattgttacatcaatgagctttttccaggatttttcaaataaacaagtaagagttagaacctgaatcaaatggcaaaatatctcatttaagtgttttcagcaacagtatgaaaaaagacttgaagaggggatgtagattttactgagaaattggacttaggcatttgaagctataatgaactttttagactttgaaacaactgactgcattgctaacaactgttatcttcctaataaaaagagttatcagtcttatctgtaactgtaacagagcttagtgaaacacattagtaagaccagcttggtgctttcactcttagtgagaaaaagacctaactaattgttatttgttaaatctaccttttttcagactattcccagaattgtgtgtgtgatttgatacatccctagggatttatctggcataagtatcaaatccttcatggcttaaaaattaataaacagttttttaatatttctggaaagaccctacctccaccccagctgccaagtcctcaaagattataaattatctatatgagtgtatgtatctgtatacacacatgcaccattacacatacaacataaatatgtatatgtatattcatttgtaaaggcaaaggtgccctggctttttcagataactgaatagaaaaacatttcatacatttaggattatttttctcctctatgtatttactagatattatatttggtttgggttgctttctgctgctgttctccttcacacacagcaaaatatacatttgtttctgtagattgacacaacttataataattactcccaaaaagttgtctgttcttttagaaaaggattaaataaggctcaggggacccacttcactctactgaatctaatgtacgagacagtactactgcttctttgtgtgcttgaatttgcatgaaagcttaatagcaaaatcttctatctcagtaattatagcaaatagggacctactggtagggagcaggtgttggctcagaaacctgaaaaagacaacccactttcatacagttctattaaaatcccctaagttttctaataaaatgatatagtccaaatatggcaatcgactggcatttatgggagcctctaaacctggaattatggggtttatttttctcccaaatgagctgcaaaagataattattgctgcccagtaaacaaaatgtatgtcaaatcagtaaagaatttgtttagcataatattgccttatctttcagaagctttcttctatattcttgtgtcttcagtacaatccacttttgtttgaaatccatttgcatattatcttactgtgcatttagtgaattctcaataatgttgtatttgctgacaagaataataaattggaccacaatt

SEQ ID NO: 30653 - DNA, 2966 bp, Homo sapiens
atggcgagcgcatcatggcgattgaaggtggagagagaacctgtggagtacatgaacttatctgtattagaaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcag

SEQ ID NO: 30654 - DNA, 5062 bp, Homo sapiens
agcgcgtcctccgccagccctcgcgtctgctgcccccgccatccagttggtgcggtccatggcgagcgcatcatggcgattgaaggtggagagagaacctgtggagtacatgaacttatctgtattagaaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccactttccaccccctgttgtcagatggactgttctgttgtctaaaacacttgataggtggacaggtttatataatccgagatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcagaacagtgtcgcaagatctttatttcctctgaagtatgtaaaagttgtataatgtgctaactttttaatggcaaggcactttcatttgtttttatatttaggaactctaatcaggaatattataagctgttttctttttaattttgcttcttacctaatatatcattttatgcatatactttatcagagtatgttttatatatattaaaaatagtttcttttttctccttctcatttctagttaaaatagacaaaaacatactatttaccagttactaaaaagcagtatatcattgcttctagtcccaactaagtactatatattattgtaaactagaacttgttattaccataataacaaaacaatgcgtagatattacttcagcttggctgtactgaaaggccttaaaagaaacccaaaaagaccgtgaacttctgtatttttttagtttaaaaaatggcagctctatgcattcatacacatgaattataagaaaaaatacaaatgctatattggatgacatgaggtttgagaatgtgtgttacagggctgcattaaagggaaaaatccatcttttattgttacatcaatgagctttttccaggatttttcaaataaacaagtaagagttagaacctgaatcaaatggcaaaatatctcatttaagtgttttcagcaacagtatgaaaaaagacttgaagaggggatgtagattttactgagaaattggacttaggcatttgaagctataatgaactttttagactttgaaacaactgactgcattgctaacaactgttatcttcctaataaaaagagttatcagtcttatctgtaactgtaacagagcttagtgaaacacattagtaagaccagcttggtgctttcactcttagtgagaaaaagacctaactaattgttatttgttaaatctaccttttttcagactattcccagaattgtgtgtgtgatttgatacatccctagggatttatctggcataagtatcaaatccttcatggcttaaaaattaataaacagttttttaatatttctggaaagaccctacctccaccccagctgccaagtcctcaaagattataaattatctatatgagtgtatgtatctgtatacacacatgcaccattacacatacaacataaatatgtatatgtatattcatttgtaaaggcaaaggtgccctggctttttcagataactgaatagaaaaacatttcatacatttaggattatttttctcctctatgtatttactagatattatatttggtttgggttgctttctgctgctgttctccttcacacacagcaaaatatacatttgtttctgtagattgacacaacttataataattactcccaaaaagttgtctgttcttttagaaaaggattaaataaggctcaggggacccacttcactctactgaatctaatgtacgagacagtactactgcttctttgtgtgcttgaatttgcatgaaagcttaatagcaaaatcttctatctcagtaattatagcaaatagggacctactggtagggagcaggtgttggctcagaaacctgaaaaagacaacccactttcatacagttctattaaaatcccctaagttttctaataaaatgatatagtccaaatatggcaatcgactggcatttatgggagcctctaaacctggaattatggggtttatttttctcccaaatgagctgcaaaagataattattgctgcccagtaaacaaaatgtatgtcaaatcagtaaagaatttgtttagcataatattgccttatctttcagaagctttcttctatattcttgtgtcttcagtacaatccacttttgtttgaaatccatttgcatattatcttactgtgcatttagtgaattctcaataatgttgtatttgctgacaagaataataaattggaccacaatt

SEQ ID NO: 30655 - DNA, 5189 bp, Homo sapiens
agcgcgtcctccgccagccctcgcgtctgctgcccccgccatccagttggtgcggtccatggcgagcgcatcatggcgattgaaggtggagagagaacctgtggagtacatgaacttatctgtattagaaaagaatctggaatctgagtgcatgctgatctcccattgacttctgttctattactgtaccccatcagagagatgtgaggagttggttgaaattcaaatcgggaacatatccaaagaccacaacatcctttgacaccaacaactgtctatgcttccttagaaggagccacctgacaactgggtggttcaacaaagtggccccaggaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcagaacagtgtcgcaagatctttatttcctctgaagtatgtaaaagttgtataatgtgctaactttttaatggcaaggcactttcatttgtttttatatttaggaactctaatcaggaatattataagctgttttctttttaattttgcttcttacctaatatatcattttatgcatatactttatcagagtatgttttatatatattaaaaatagtttcttttttctccttctcatttctagttaaaatagacaaaaacatactatttaccagttactaaaaagcagtatatcattgcttctagtcccaactaagtactatatattattgtaaactagaacttgttattaccataataacaaaacaatgcgtagatattacttcagcttggctgtactgaaaggccttaaaagaaacccaaaaagaccgtgaacttctgtatttttttagtttaaaaaatggcagctctatgcattcatacacatgaattataagaaaaaatacaaatgctatattggatgacatgaggtttgagaatgtgtgttacagggctgcattaaagggaaaaatccatcttttattgttacatcaatgagctttttccaggatttttcaaataaacaagtaagagttagaacctgaatcaaatggcaaaatatctcatttaagtgttttcagcaacagtatgaaaaaagacttgaagaggggatgtagattttactgagaaattggacttaggcatttgaagctataatgaactttttagactttgaaacaactgactgcattgctaacaactgttatcttcctaataaaaagagttatcagtcttatctgtaactgtaacagagcttagtgaaacacattagtaagaccagcttggtgctttcactcttagtgagaaaaagacctaactaattgttatttgttaaatctaccttttttcagactattcccagaattgtgtgtgtgatttgatacatccctagggatttatctggcataagtatcaaatccttcatggcttaaaaattaataaacagttttttaatatttctggaaagaccctacctccaccccagctgccaagtcctcaaagattataaattatctatatgagtgtatgtatctgtatacacacatgcaccattacacatacaacataaatatgtatatgtatattcatttgtaaaggcaaaggtgccctggctttttcagataactgaatagaaaaacatttcatacatttaggattatttttctcctctatgtatttactagatattatatttggtttgggttgctttctgctgctgttctccttcacacacagcaaaatatacatttgtttctgtagattgacacaacttataataattactcccaaaaagttgtctgttcttttagaaaaggattaaataaggctcaggggacccacttcactctactgaatctaatgtacgagacagtactactgcttctttgtgtgcttgaatttgcatgaaagcttaatagcaaaatcttctatctcagtaattatagcaaatagggacctactggtagggagcaggtgttggctcagaaacctgaaaaagacaacccactttcatacagttctattaaaatcccctaagttttctaataaaatgatatagtccaaatatggcaatcgactggcatttatgggagcctctaaacctggaattatggggtttatttttctcccaaatgagctgcaaaagataattattgctgcccagtaaacaaaatgtatgtcaaatcagtaaagaatttgtttagcataatattgccttatctttcagaagctttcttctatattcttgtgtcttcagtacaatccacttttgtttgaaatccatttgcatattatcttactgtgcatttagtgaattctcaataatgttgtatttgctgacaagaataataaattggaccacaatt

SEQ ID NO: 30656 - DNA, 1369 bp, Homo sapiens
aagagacggcctggcagcccagccccagccgcccagaccggcgagaccagcctgcgggagcagccccatggcggagcagctggccctggtgattgggggcaccatcggggggctgctgctgctgctgttgatcggggcaagctgctgtctgtggagaaggttctgtgccaccctcacctatgaggagctgcctgggacaccagccatggccaccacagctgcctccagtgggcagcgggacaggccctgccagccgcatgctaggacccaactgagcaggccaccagctgtgccattcgtggtgcccccaacccttcaaggccgagattgggtgcccctgcacagtggagagtgggccgatgccccatgggacccctgcccggcatcagagctgctgcctcacacctccagcggcggccttggagatgcatgtatggtgggggccatcaacccagagctgtacaagttcccggaggacaaaagtgagaccgacttccccgacggctgcctggggcggctgtggttctcggtggaatatgagcaggaggctgagcggctgctggtgggcttgatcaaggcacagcacctgcaagccccctcggagacctgcagccccctggtgaagctctacctgctgcccgatgagcggcgcttcctccaatccaagaccaaacgcaaaacctccaacccgcagtttgacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggccgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagagccagcagctgggccgagtggtggtgggcccctacatgtacacccgcggcagagagctggagcactgggacgagatgctcagcaagcccaaggagctggtgaagcgctggcatgcgctctgccgcaccacggagccctgacccttcgcccagcaccgcggttccgctttgggagcc

SEQ ID NO: 30657 - DNA, 3537 bp, Homo sapiens
gttctaataatcaccataataataggcgctgggtgtacagaggggacccaggcgacgctggcctccatccgataaccaccgtaacaggggctgggccgcgccgctcctccgctctaagtgctctttacatgcttcttaagttaccggcaggccagccgcccttacgagagcccctcacggacattaacccaattgagaagactgaacccagcttacgaacgttaagttgtcccaaatcgcagggctggcgagtgaggagcctgaattggaacccaggagcttctggaacccgctccagaattgcgctctcgaccggtttgtccgctgagagcgaacgggtgcgcgagcgccgcatccctgcccaaggccatcaggcaggcagcgctggggccggggacccgcgcggagactccaccccgggatccgggaaggctcccccgagccggggtcggagctgcggctggaggggcctcggcttgaggaggatctgggagggcgggggctcagtcctggccaccaggtgtgaggggtcgggtgcggagccctgtgtcagacgcggcggtgaaggctgtagccctgctctccgggatgggggtggtactctcaccccaccctgccccaagccgcagggagcccctggcgcccctggcgcccgggacccgccctggctggagccctgcggtttccgggagctcacggtcggctctgcgcccctccaccgccgggcctgggcctgggccagggacgggctggggcgggactgcggcctcggggcgctgggtccctgcccctgccgtgcactgcgcggctccccgcgccgcagctgggcaccagcagcaccacggaccgcccctgtgctcgcccgacggcgccccgcggcgctttaagagacggcctggcagcccagccccagccgcccagaccggcgagaccagcctgcgggagcagccccatggcgggccaccagctgtgccattcgtggtgcccccaacccttcaaggccgagattgggtgcccctgcacagtggagagtgggccgatgccccatgggacccctgcccggcatcagagctgctgcctcacacctccagcggcggccttggagatgcatgtatggtgggggccatcaacccagagctgtacaagttcccggaggacaaaagtgagaccgacttccccgacggctgcctggggcggctgtggttctcggtggaatatgagcaggaggctgagcggctgctggtgggcttgatcaaggcacagcacctgcaagccccctcggagacctgcagccccctggtgaagctctacctgctgcccgatgagcggcgcttcctccaatccaagaccaaacgcaaaacctccaacccgcagtttgacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggccgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagagccagcagctgggccgagtggtggtgggcccctacatgtacacccgcggcagagagctggagcactgggacgagatgctcagcaagcccaaggagctggtgaagcgctggcatgcgctctgccgcaccacggagccctgacccttcgcccagcaccgcggttccgctttgggagccgaccatcctcgcagttgcatgtgacagccacagccacacgcatggacgtttcatccaacagctccccgagctgccagccagcccgagccaggaggacgtgagtgctgatatgcaggagagaagaggggacaaagaagccctggcccggtcagcggctctggccatacagccttccgacacactccctcctccttatctgcggggctgcctgggctcggaatcccggctcctggtcctcacagccctgatttggaccagaatctcagatgctcagaagaaagatcctgtttagtgatgacccagctctacctgctgaatggacctgcagggtaaacttgggtgcctccatctgggaaagctgatgatgtgttcatgcagtcgatgaccctcactgctttttcagccagggtttctctgccttctgcctggcagagaaaacacactgctatggggaaaatcacagggagggcgctgtgaccagcgcactcaggcaccaagtgtcggcatggctcactgtgctgggtgaaggcctccccgagcattaggtcctccacggggctgtgtcaaatgccctcccacattgtgtcaagtctgcccatggcccaccctccccacagtccaaaaccacacagccctggttctccagctgttctgctgctgtttctgtgctctccctgattaagagcattcagttcctgggctctccctttgagcaggaaatggtgaaagcatgtggctatggtatagcccacagggctgagattgctgtgttgcagtattgatgtaaaatttgttaagaaggaagtacccacagatcactgccatcaactccccagaagttgcactcaagctagtgagcagcccttgtgcttgtcacagttactgtaacaggtagtgtgtatttgcacctggcatcgtgcagcctgcacgtcaacacgttgttttgtgtaactagaacagcacatggaaccactatctctttctcttttttccttctttttcttttttttttttttattttaattttttgagacggagtttccctcttgtcacccaggctggagtgcaatggcgtgatctcggctcactgcaccctccacctcccaggttcaagcgattctcctgcctcagcctcccaagtagctgggattactggcgcccgccaccatgcctggctaattttttttatttttagtagagacggaattttaccatgttggctaggctggtctcaaattcctggcctcaggtgatccacctgcctcagcctcccaaagtgctgggattacaggcatgagtcaccgcacccagcccgaccagtatctttttcttatgcagtgaaacaactttagcaaaagaggcaatgaatgttatactgagtttctacctctttaactccacctccaatttctgtcaatctacaaacacaagtgtcgcctcgcagtgtttcgtatgaacagaatatcttgtgtttgctttttgtcactt

SEQ ID NO: 30658 - DNA, 1536 bp, Homo sapiens
actgcgcggctccccgcgccgcagctgggcaccagcagcaccacggaccgcccctgtgctcgcccgacggcgccccgcggcgctttaagagacggcctggcagcccagccccagccgcccagaccggcgagaccagcctgcgggagcagccccatggcggagcagctggccctggtgattgggggcaccatcggggggctgctgctgctgctgttgatcggggcaagctgctgtctgtggagaaggttctgtgccaccctcacctatgaggagctgcctgggacaccagccatggccaccacagctgcctccagtgggcagcgggacaggccctgccagccgcatgctaggacccaactgagcaggccaccagctgtgccattcgtggtgcccccaacccttcaaggccgagattgggtgcccctgcacagtggagagtgggccgatgccccatgggacccctgcccggcatcagagctgctgcctcacacctccagcggcggccttggagatgcatgtatggtgggggccatcaacccagagctgtacaagttcccggaggacaaaagtgagaccgacttccccgacggctgcctggggcggctgtggttctcggtggaatatgagcaggaggctgagcggctgctggtgggcttgatcaaggcacagcacctgcaagccccctcggagacctgcagccccctggtgaagctctacctgctgcccgatgagcggcgcttcctccaatccaagaccaaacgcaaaacctccaacccgcagtttgacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggccgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagcaggctactacagtggaactgtttctgtttcatctgacatccggatagatgccagccacccccacattccaagattccagttctttgatgaaagtctctattccacccatcaagtctgtgtctgataacaccaatatctgggtcattagtggctccgttttgttgtgtctgttttcccctccttcctgttttgtggtgtgtttgatcacttattgttgaatgctaaccattataataaattttagtggctccaggaaa

SEQ ID NO: 30659 - DNA, 753 bp, Homo sapiens
gacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggccgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagcaggctactacagtggaactgtttctgtttcatctgacatccggatagatgccagccacccccacattccaagattccagttctttgatgaaagtctctattccacccatcaagtctgtgtctgataacaccaatatctgggtcattagtggctccgttttgttgtgtctgttttcccctccttcctgttttgtggtgtgtttgatcacttattgttgaatgctaaccattataataaattttagtggctccaggaaa

SEQ ID NO: 30660 - DNA, 1478 bp, Homo sapiens
actgcgcggctccccgcgccgcagctgggcaccagcagcaccacggaccgcccctgtgctcgcccgacggcgccccgcggcgctttaagagacggcctggcagcccagccccagccgcccagaccggcgagaccagcctgcgggagcagccccatggcgggccaccagctgtgccattcgtggtgcccccaacccttcaaggccgagattgggtgcccctgcacagtggagagtgggccgatgccccatgggacccctgcccggcatcagagctgctgcctcacacctccagcggcggccttggagatgcatgtatggtgggggccatcaacccagagctgtacaagttcccggaggacaaaagtgagacctgcagccccctggtgaagctctacctgctgcccgatgagcggcgcttcctccaatccaagaccaaacgcaaaacctccaacccgcagtttgacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggccgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagagccagcagctgggccgagtggtggtgggcccctacatgtacacccgcggcagagagctggagcactgggacgagatgctcagcaagcccaaggagctggtgaagcgctggcatgcgctctgccgcaccacggagccctgacccttcgcccagcaccgcggttccgctttgggagccgaccatcctcgcagttgcatgtgacagccacagccacacgcatggacgtttcatccaacagctccccgagctgccagccagcccgagccaggaggacgtgagtgctgatatgcaggagagaagaggggacaaagaagccctggcccggtcagcggctctggccatacagccttccgacacactccctcctccttatctgcggggctgcctgggctcggaatcccggctcctggtcctcacagccctgatttggaccagaatctcagatgctcagaagaaagatcctgtttagtgatgacccagctctacctgctgaatggacctgcaggagcaggctactacagt

SEQ ID NO: 30661 - DNA, 1200 bp, Homo sapiens
actgcgcggctccccgcgccgcagctgggcaccagcagcaccacggaccgcccctgtgctcgcccgacggcgccccgcggcgctttaagagacggcctggcagcccagccccagccgcccagaccggcgagaccagcctgcgggagcagccccatggcggagcagctggccctggtgattgggggcaccatcggggggctgctgctgctgctgttgatcggggcaagctgctgtctgtggagaaggttctgtgccaccctcacctatgaggagctgcctgggacaccagccatggccaccacagctgcctccagtgggcagcgggacaggccctgccagccgcatgctaggacccaactgagcaggccaccagctgtgccattcgtggtgcccccaacccttcaaggccgagattgggtgcccctgcacagtggagagtgggccgatgccccatgggacccctgcccggcatcagagctgctgcctcacacctccagcggcggccttggagatgcatgtatggtgggggccatcaacccagagctgtacaagttcccggaggacaaaagtgagaccgacttccccgacggctgcctggggcggctgtggttctcggtggaatatgagcaggaggctgagcggctgctggtgggcttgatcaaggcacagcacctgcaagccccctcggagacctgcagccccctggtgaagctctacctgctgcccgatgagcggcgcttcctccaatccaagaccaaacgcaaaacctccaacccgcagtttgacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggccgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgccaaatgcaagcctgggccagacttgggggaggaatcaagaggaagcttaaacttaaaatga

SEQ ID NO: 30662 - DNA, 1331 bp, Homo sapiens
cccagaccggcgagaccagcctgcgggagcagccccatggcggagcagctggccctggtgattgggggcaccatcggggggctgctgctgctgctgttgatcggggcaagctgctgtctgtggagaaggttctgtgccaccctcacctatgaggagctgcctgggacaccagccatggccaccacagctgcctccagtgggcagcgggacaggccctgccagccgcatgctaggacccaactgagcaggccaccagctgtgccattcgtggtgcccccaacccttcaaggccgagattgggtgcccctgcacagtggagagtgggccgatgccccatgggacccctgcccggcatcagagctgctgcctcacacctccagcggcggccttggagatgcatgtatggtgggggccatcaacccagagctgtacaagttcccggaggacaaaagtgagaccgacttccccgacggctgcctggggcggctgtggttctcggtggaatatgagcaggaggctgagcggctgctggtgggcttgatcaaggcacagcacctgcaagccccctcggagacctgcagccccctggtgaagctctacctgctgcccgatgagcggcgcttcctccaatccaagaccaaacgcaaaacctccaacccgcagtttgacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggccgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagcaggctactacagtggaactgtttctgtttcatctgacatccggatagatgccagccacccccacattccaagctcttgccaaactgcagtggctgagcaattggacaagataaagaaataaaagtgatccagatcataaagaaagaagtaaaactatatctgcacatga

SEQ ID NO: 30663 - DNA, 1811 bp, Homo sapiens
agcgacatcatttagtgtggattatggcggggggaaaacattctgaaaagtgaagtgtaacctgggacctgaaaggagatggatgggcactgtcagggtcagggagcctgaagggagaagagctttcttagcctgtgagaggagcctgagcaactaaaaggaggaggtgagatgccccagcctggagagcaaatagcacttaaagacaagatggaaccaaccagggatggccttctgagtcttgtgaattttgaactttgccataagtgcaatgggaagccattttaaacactgaatgacgtgatcaaatatgcaccttagaaagatcatgaagttcattttgtggaaatgagctggaagttttgagagtgaaatattcacagccattaagagacctccaaattaatttctcaacatgcttattctatagttcacattcaatccagagcactgaaggaactgaacaactggacactgtagacatcagatagctggccatggtgttggccatggcgtctcaggatgttcagaacttcttccagcctttctcttcctggatatctcgggtttatgaagctctccagcaagcaggagatatgttatctgcttcgctggttaacataagcaaacaagactctaaattgagtgacaaactagatcaggacttagataatattcagattcaggaaacgtactttgaagatgaagaacaagacaatgattggagtcaagaggatgcaaattccttgtttcttgaagtggatcatttctcatgttgtaatagtgatttgcaggactctgcccaaaattcaagcccaagccttagccaacatgcaaaggactcatgttccacaatgtcccagtggcccaattgggccagtgatgaccgcaagttaccacatgtgctttcttctattgcggaggaagagcatcaccttgaaaagcaaagaagtggccttcaacatggctttgacagccagctccctggtactttagaaactgttaatggaaaaaagcaagtcaacagctttggggatgacgaagagctgtccacatcttctgacagtgacgaggaggtgatcaaacaatttgagatttccgtgtcccggtcccagagtttccgttcagtgacatctgagaaaggaaagcagacaggattggagcagaaaccaaaattcagccgttcgttgttgacacacggagaagatggcacagaagtatctgcctgcgaagatttggatggagccagccaacggcgttattctgagaatctctcctacggtgaagatgaccacatccctgctcactcacagtccccatgtgaaagaggggatgccaaacaccacggcacatctcaccaagagtccagtgtggtccaaagcctcaggcgccaatccacagagggcagcttggagatggagacagcttttaatagccggggatttgaagattcctatgccactgacagctcctccatgtggagtccagaggctaatttgaatcttaaaagaaaaggatatttattagatgtctactgtctgtcaagtcctctactttttacaacatccctacacagaaggaacaggacaggaccaatttgcaggtgccatccggggtctcagagcccatctcaaagtgtggtgacctagatgtcatctttgaatatagagccgccagccagaagctcacagtgaccattgtgagggcacagggcctcccagataaggaccgaagtggtgtcaactcctggcaagttcatgtagtgctgctgcctggtaagaaacacaggggcaggacgaacatacagagag

SEQ ID NO: 30664 - DNA, 3134 bp, Homo sapiens
gggtctgaggttgtaactttaacaggtgtaagtatttctttcctctgtttcagctggaagttttgagagtgaaatattcacagccattaagagacctccaaattaatttctcaacatgcttattctatagttcacattcaatccagagcactgaaggaactgaacaactggacactgtagacatcagatagctggccatggtgttggccatggcgtctcaggatgttcagaacttcttccagcctttctcttcctggatatctcgggtttatgaagctctccagcaagcaggagatatgttatctgcttcgctggttaacataagcaaacaagactctaaattgagtgacaaactagatcaggacttagataatattcagattcaggaaacgtactttgaagatgaagaacaagacaatgattggagtcaagaggatgcaaattccttgtttcttgaagtggatcatttctcatgttgtaatagtgatttgcaggactctgcccaaaattcaagcccaagccttagccaacatgcaaaggactcatgttccacaatgtcccagtggcccaattgggccagtgatgaccgcaagttaccacatgtgctttcttctattgcggaggaagagcatcaccttgaaaagcaaagaagtggccttcaacatggctttgacagccagctccctggtactttagaaactgttaatggaaaaaagcaagtcaacagctttggggatgacgaagagctgtccacatcttctgacagtgacgaggaggtgatcaaacaatttgagatttccgtgtcccggtcccagagtttccgttcagtgacatctgagaaaggaaagcagacaggattggagcagaaaccaaaattcagccgttcgttgttgacacacggagaagatggcacagaagtatctgcctgcgaagatttggatggagccagccaacggcgttattctgagaatctctcctacggtgaagatgaccacatccctgctcactcacagtccccatgtgaaagaggggatgccaaacaccacggcacatctcaccaagagtccagtgtggtccaaagcctcaggcgccaatccacagagggcagcttggagatggagacagcttttaatagccggggatttgaagattcctatgccactgacagctcctccatgtggagtccagaggaacaggacaggaccaatttgcaggtgccatccggggtctcagagcccatctcaaagtgtggtgacctagatgtcatctttgaatatagagccgccagccagaagctcacagtgaccattgtgagggcacagggcctcccagataaggaccgaagtggtgtcaactcctggcaagttcatgtagtgctgctgcctggtaagaaacacaggggcaggacgaacatacagagagggcccaaccccgtcttcagggagaaggtcacctttgccaagctggagcccagagatgtggctgcctgtgctgtccgcttccgcctgtacgctgcccggaagatgacccgagagagaatgatgggagagaaactattctatctcagccacctgcacccagaaggggaaatgaaagtgactctggttctggagccaagaagtaatataagcagtggagggtctccgctcagcccatctgcggtttctcacagtgatagtacttcatccacgcagtcgctgtctcatggaggggcgccagagctgttggtggggctctcgtacaatgccacaacggggcgattatctgtggaaatgatcaaaggcagccatttccgaaacctcgctgttaaccgagcacctgatacatatggaaaactctttctcctcaattctgtgggtcaagagatgtcccgttgcaagacgtccattcggcgtggtcagcccaatcctgtctataaggagacctttgttttccaggtggccctctttcagctgtctgatgtcacgttgatgatttccgtttataacaggcgtactatgaagcgtaaagagatgattggctggattgccctgggccagaacagcagtggagaggaggaacaagatcactgggaggagatgaaggaaaccaaaggccagcagatctgcagatggcacactttgctggaatcctaggtttgctaacctgcatttgtgtgctgtgtccaccttggttacctgtgttgctgtctactgacactaagtgtcctggcaagggtttcagggtttcaaaaacagattccactaacccctaggacattgtgagtgggagttttgggtttctcaatggtctgatttggatttaaatattgtaattttaaaaacacacatacacagtgaagtgtccgtatggaaaatattataccacaattaagaccactgatgagttaatttgtgccaatagatcattgagttttagttcagggtatggggtgaagcttcttctgctgtctctgtttgcttgaagagtaacctgagattgcaagggagctgttaattgttactatttgcaaccatttaggtggatgaatcagaattttcttaatatggtacaaaaaactccaaaatatagatatgaatcagatgctgagcctcataaaagaatcaaactctaatccataaactcttatttcacatttttctctttatcaaagaaacctatttacctaacgagtaaatattataaacttgcacttttaaaataaatttgtattaattaaatacctcttttatcttatattttgtggtttctatgagatttggttagatgaatcattttgaagcaagaaaagagttcagaaactactgttttaagacaacttgtctccttttgaatatgtaagatttcaaacttgtgactttcaaggtttttatgctgtctttctcacccaataagttcttacagaataagaaaacaaaaaacaagactactgcagtcatagatttattgattttttctgcttctggtgttcttttggattatcctttttctatgttcaattatatatactcatatatgaatattttgaatgtactgcatgtaaaccatgctctttttaaactgagtattttccatcactagagcatagtaaattgtacacagtgagtccttaataaatattgatttgattgact

SEQ ID NO: 30665 - DNA, 1898 bp, Homo sapiens
agctgctggctgggctgcctgttgagtcagccttcttccctcacggctcttctcccggtccctgaaactcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccaggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgaatgggtggatggccttctacccctcagaaccaacctggcccccaggacgtagccccaccaagcctctctctctggacccccatctcagggcctgcccttggctaaagtcaataaagtctattctaagagc

SEQ ID NO: 30666 - DNA, 312 bp, Homo sapiens
tgcccctcagcgctgggcaaatgctttctttccggagtcactgtggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctga

SEQ ID NO: 30667 - DNA, 2525 bp, Homo sapiens
ttccctcacggctcttctcccggtccctgaaactcggctgccaggggagctggagccacctgcgaaggtgtcctcccatactggacccctacaggtaacacgtgtcggtgccagggtcccctgccagggtccagagacgcaggcactgccacctggtatcctgagcaccctccagcaccttggggttgggggaggtgggcacatgtctggaactggaacagctggacagatggacagaccctcctcttgaccaatgggtctgtcccaccgtgtcaaaacagcagagaagaccaaactcctacctaactctggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccaggtaggcgggagtggcccgtggctgctctcaacatccggagcggactccgggcggggagcgctcctgcccagggctgcgagccgcccgcgacccagggcgctcggggcaggggtggggaaagaaggggcgccccgtcacttgccccctctgcagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccgtgagtgccccgccggccaagcggggcgcggctgtcacagcccagcccaccattcacagggtctcggcctcctcgtcctcatcttcaaaatgggaacaacagcgttattgggaggcgtgcgattaagcgagacaatccctgtaaagcgcttagcacgaggcctggcacgtgttcgggatggtggctgggggagcccacaggcaggggagaaggctctgggagggcccctcctcacctcgggttctcacctccccagctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccaggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgaatgggtggatggccttctacccctcagaaccaacctggcccccaggacgtagccccaccaagcctctctctctggacccccatctcagggcctgcccttggctaaagtcaataaagtctattctaagagc

SEQ ID NO: 30668 - DNA, 895 bp, Homo sapiens
cagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccgtgagtgccccgccggccaagcggggcgcggctgtcacagcccagcccaccattcacagggtctcggcctcctcgtcctcatcttcaaaatgggaacaacagcgttattgggaggcgtgcgattaagcgagacaatccctgtaaagcgcttagcacgaggcctggcacgtgttcgggatggtggctgggggagcccacaggcaggggagaaggctctgggagggcccctcctcacctcgggttctcacctccccagctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatggtgaggagtgctggccctccgggc

SEQ ID NO: 30669 - DNA, 4236 bp, Homo sapiens
accccaccttgagctcagccatcctggggtggcaccctacccatacccggccaagtgtttggggagaaaagggctgttggttctaggatgtgccaagcatttgtgcagggcttgacctgaccctcggtctgcccccaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccaggtaggcgggagtggcccgtggctgctctcaacatccggagcggactccgggcggggagcgctcctgcccagggctgcgagccgcccgcgacccagggcgctcggggcaggggtggggaaagaaggggcgccccgtcacttgccccctctgcagaccaaggccgcgtcccagatcctggagaatggggaggaggccccggggcccgacccctctctcgaccgcatgctcagcagcagctcctcggtgtccagccttaactcctccacggtgaggcgggagggaggggacccgggcggccggggggtggacccgttccgatgcgtagcccctgcctgcccctccctcgccgcgggacccaccgctgcagccccccagcctgccacctatgacccgggtctgaagcctccgcgctgcccgcggccccgacgtgagccctgcgagcggccctgactcccacccactcccgtccgcagctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccgtgagtgccccgccggccaagcggggcgcggctgtcacagcccagcccaccattcacagggtctcggcctcctcgtcctcatcttcaaaatgggaacaacagcgttattgggaggcgtgcgattaagcgagacaatccctgtaaagcgcttagcacgaggcctggcacgtgttcgggatggtggctgggggagcccacaggcaggggagaaggctctgggagggcccctcctcacctcgggttctcacctccccagctacgtcaaaagctacctcctcccggataagcagagcaagcgcaagacggcggtgaagaaacggaatctgaatccggttttcaacgagactctccgggtgaggctgtgaccacgatgcggttccccgttaatgaactggacgcccccttcctgcggggctaggtggcaagggcagccagtaacgtcattgcccggaggatcggcggagggggcccattaactcgttatccagtgttgtcagcctcgtggtgggcgtggtgatagtgcaggtccccattaatgcccttaggggctccccagaattccatcatggtaggaacgcggtaggacctgcctcagccaactcgcgcagcatctacgcgggccaccagcagtgctccactaaagctcacctcctgtcctcagtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtgaggcagccaggccgcgtggggagacctgcggcccgggtctcctgcatttaccccaccaggctctcccgcagccccctcacaccccgccttcgacagaacctcccctcaacctcttaacctcatggccccaggcgaagcccggccggccacggccccttccccgagggcgctaggacccctaggttctgcccctgcaggccccgccgtctcttctagccgcaccccatccgggtctgcagaccccaccctcctgaggcccctttccattagcccctgctccacgataagcccgcctctcgcaggtcccaccctctcccgacgaccttccgagccgcgggttactcgccctgtccctcaagtacgtccccgccggctccgagggtgagtgacagccggagaggccaagctggacacgccctgaaaagcgggagactccagtccccgggtttgggggcggtggactccatccgtgtgcgggcctgagccgagcctctccgcaggcgcaggactgcccccgagcggggagctgcacttctgggtgaaggaggctcgggacctcctgccgctgcgggcaggatccctggacacttacgtacaatggtgaggagtgctggccctccgggcttcccattcttttgcctgcagtggagtgcccaacctccacaaacccttactaatcaacctttgatcacgcagcctgggctttcaccactgagcaggggtgaaggggacggtttgagcaaaggcctggagtcagggaagttgaggacacctttgaggagctgcatttcagcgtgactggcgcctataggacttgttgaaaagctgaggctgagggctgcaagggtccttccatagagaacctgggaggccaggctgtggggcttggctgggaacttatagttcagtgtaagcttctaggggacttctaggggtgcctccaggtgctgcccccactgttagagagtgaaatggaggtgggcgggtcacttctgggtgtccactctgatgcagccagaggctgcagtacagaggtactgtacttctgagcaacactgtattttgcagagggggttcccaggctttgaaaaccttggaaacaggcgtgagcaacctcgcccggccaggagctgtaacttttaaagccaggagacctgagaggaggctggtgcaaaggtcccagggcagtgagggtctaaggccaggcaggcaggagccaggggacatggacatatgtgagagagaatgagtgggacgtggtgactggatgactctagggagtgtgaggggggtcacctgatgccaggccacctcccgcacagcttcgtgctgcctgatgacagccaggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggtaagtgggacagcaccctgagacaggccctgggacaggccctgggagatgggggctcagtgtgtggccctggatacctctctgtcctttcctgagctttgatatctactgagaactgagggtggtaacgggggacagtgcataatctgggaccaggcaggtgtttgggggccccaaggtgtccagtgtgatcatgccctcaacccctgcccacccacatccaggcagcagctatgggctgcaggtgccctggatggattccacacctgaggagaagcagctgtggcaagccctcctggagcagccgtgcgaatgggtggatggccttctacccctcagaaccaacctggcccccaggacgtagccccaccaagcctctctctctggacccccatctcagggcctgcccttggctaaagtcaataaagtctattctaagagc

SEQ ID NO: 30670 - DNA, 876 bp, Homo sapiens
agccgcggccccagcaagcccaggtaggcgggagtggcccgtggctgctctcaacatccggagcggactccgggcggggagcgctcctgcccagggctgcgagccgcccgcgacccagggcgctcggggcaggggtggggaaagaaggggcgccccgtcacttgccccctctgcagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacactt

SEQ ID NO: 30671 - DNA, 2229 bp, Homo sapiens
gtgtgtgcatgtctctcgtgggcatgggtccgggtctgtgtctgcagagggccctttctgggggaacagctgtgcatgcgcctgtctttatgcaggtgtctgtgtgcatgtgcgaccatatctatgcctacatggacccgcgtgtgcacatgtgtctgtgtgttccatcgctgcagtcctgtgtggccctacctcagggtgtgtgcatgtgtgtctcttgcttcttccactgtgtctccaagtgtgttcaagggctagtgtatgcatgtgtgcatgagtgtctctcaccccaccttgagctcagccatcctggggtggcaccctacccatacccggccaagtgtttggggagaaaagggctgttggttctaggatgtgccaagcatttgtgcagggcttgacctgaccctcggtctgcccccaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccaggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgaatgggtggatggccttctacccctcagaaccaacctggcccccaggacgtagccccaccaagcctctctctctggacccccatctcagggcctgcccttggctaaagtcaataaagtctattctaagagc

SEQ ID NO: 30672 - DNA, 4293 bp, Homo sapiens
cacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggaggtaggtgatgctctgatgctgctgcctcttatgaattgacgacaggtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagcagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaa

SEQ ID NO: 30673 - DNA, 4751 bp, Homo sapiens
ctaaaagaaagaatggatgaacccaatgcagaacaggtctataatccctctcagtttgagaatttgagaaagttttgggacttagaagctaattcaaacagtaaggataatgacaagaatattaccaccacaagccaaaaaaattctgcaccttttaataggcagaaacacaaggaattcagcgacattaaattatcaggtaaaaatacccatgaagcagaggtgcttctaagcccaaaaaaagttatggcaagagaggaaatggagaaattaaattcaaagggcatactccaggtgctaccagatgaaatcacatttcctttgagtccacttagaaagtatacttatcagttgccaggaaatgagtcatcaaaggaaaatgtggaaaagaatacggaagggattgttactccagtgtttaaggaagaaaaggattactcagaacaagagattcaagaatccataataaaaaccaatgttttgtctaaagactgcaaagacacttttaatgacagcttgcagaaactgctttcagaaacctcaacaccagcaattcaaccctctggtggaaaagttcatggaaaacaagtgcttgaaccaagtgtttctgaaaataggacatggcctcaaaaaacagattttgctgatactgaggaagaagtcaaaggacctgagaagatcattaatgagcatgttgacaaaacagtagttcatccaaaggttaaacggaactctttgactgctagtctagacaaactcctgaaggaagcaactggaacttcaccctctcccttgcaagccaagttggcgcctgttatcactggaaccaactctaagctggaagaggggagattttttggaaaagggatagaacagagtcacaatacttcagctgataagagagaaatactagctccttttccagtgagagatgaaacttttggaaatacagctctcctcaagaaagctgaaagtggtgagtgccagctaagcacacagaatttgattcagatggctgcagaagattctcatccattggatccaacttcccagctttccagaaagggttcttttggggatgtggccagccctccccaagatatgctttttccccaggatgctcatcttgttccccaggctagggtacacccttctcaaacggaaatttcggagactgtagagaaagtcattcttccacccagacctgtattgaatgatgtaagtgctgcattacagaagctgtgtggagaagtatggttaagttatccagctggaagggaagtaggtcctggagaagtgaacccagaatttcctgaagcagtacagccagtatgtagccccctaaatcctccaggagtgatatcaccatgggctacgatggacaccatagttccagacaggaaggatttttattcctccaatgtagttcctgataaaactcatgaagttggatcttatttagctgcccaaatgtctccatcagaccagacgcttagctcatttgcttccattgttgctcaatatggcaaaggcctccctcaggaagtggaagaaattgtgagggaaacaattgttcaacccaaatcagagttcctcgaattcagtgctggcttagaaaaactactgaaggaagaaactgaaaccttcccctcaaaatatgaaagtgatacagggaatctttctccatcaaagttaataggtagtacagaggagcccaggcgagccacttctgaatgccatcctgaggaattaaaagaaacagtagaaaaggccgaggctccgttaataactgagagtgcttttgatgctggttttgagaaacttcttaaagaaataactgaagctcctccttatcagccccaggtgtcagtgagagaagaaactcacgagaaggagtcctcacagtcagagcagaccaggttcttggggacagtgccccatttttacagggcagcctcacagacctctgaaatgaaggataaaagtaatggtttggaatctcaagtcaaccaatgtgataaaatgttgggaggagacgcacttgtgactgatttattggtagatttttgtggttccagaagtggagttgagatccctagaaccccacaactttatgtggctcatgaaatagggaccattaaaactgtaacccccccagaggacagggacagtgaaagtggggttgcagggggacaagggactcttcaggaacctggctttggagaggcttctgaagcaattagtgtgtccagaaataggcaacccattcctctcctgatgaacaaagaaaactctacaaaaacaagtaaagttgaattgactctagcatcgccatatatgaaacaagagaaagaggaagaaaaagaaggtttctctgagtctgatttttcagatggaaacaccagttctaatgcagagagctggagaaatccttccagttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaa

SEQ ID NO: 30674 - DNA, 6314 bp, Homo sapiens
atgattaacagttctttaagcatgctcttttcttatttagaaaagtatttctatgttgcagatgaactgtctcattgtgttgagcctgagccatctcaggtgccaggtggcagttctagagaccgtcagcaaggtaagccccctcctctcccggctctaaaagctaagacatcttcacgttctggtccatatgccactgagataaagaagtcaactgatgattccatatttaaagttctagactggtttaaccgaagttcttattcagatgacaataagtcattcctccaacatccccgaggaatagagtccaaagaaaaaacagactcaaaatcacaggttgctgttgacttggtgacagatgacactactttaagagaaaatggctcaaagaccctatcacccagcaaaattgaattgaagcctgtgagatctgactcaccattccaagcagagggagatatgctggtttctgaaagttgccaagataataatgtgaatatcaaatccaaattcatgaatttgtcccaaaaaggcaccccaaaggaaggcccaggtatattgcaaccatttgaaagctatggcaccccaagtcaagggagtaaaaatatggactatagccaagattcaaaaagcccaggaaaagggaatggggcatctccttcaaatagtaactattcctacagtgttctcaaggaatctgatgcagaaaaccaagttccatgcaacactaataatattggcaacttgggtgaagaagaacccaagtttcatgctcatgaagaaaatagaggacactcagaagtgaattttgactcttcaacagttgtcaaagaaccaggtttgaaagataacatgaatgcagagagaaagagcaaagtaggaaatacctatatcctgaaagcctccttagagccagagaatattaagtcaacacctggggttgccaacaatggctctccttggaagaagcctgaggtccaattccagcaagaagctggtgaggttcccaagaaccaagtgcagagagagaaatacaaaagagtgagtgacagaatatccttttgggaaggagagaaagctggtgctaagataactcatgaaaaacccacatcttcatgtagccaggaacaaccttctgctaaagcatatcagcctgtgaagaagtcacagggtgtatcatccatggacagtttatctacagaccagagtgaatataatcaggccattcccaaacgagtggtcttagatgaggatgatcaagcatcccagctctccaattcttattcctcaaataaatctaaagagaccaagccacaaatagcaggtccatccagatactatctttcagctgagcaatcagataaagtgtctctgtttcagaataagaaaaatgagcctataaaaagatcacaagtggcagacagtttgccttctagaagaaacattactttaccagcactgcaacctccctcaaatgtcgggagtgaacgacatgctccattggagaaagacagacctctagttcgtgaatcaaatgccaactttaaagttatgtccctaaaagaaagaatggatgaacccaatgcagaacaggtctataatccctctcagtttgagaatttgagaaagttttgggacttagaagctaattcaaacagtaaggataatgacaagaatattaccaccacaagccaaaaaaattctgcaccttttaataggcagaaacacaaggaattcagcgacattaaattatcaggtaaaaatacccatgaagcagaggtgcttctaagcccaaaaaaagttatggcaagagaggaaatggagaaattaaattcaaagggcatactccaggtgctaccagatgaaatcacatttcctttgagtccacttagaaagtatacttatcagttgccaggaaatgagtcatcaaaggaaaatgtggaaaagaatacggaagggattgttactccagtgtttaaggaagaaaaggattactcagaacaagagattcaagaatccataataaaaaccaatgttttgtctaaagactgcaaagacacttttaatgacagcttgcagaaactgctttcagaaacctcaacaccagcaattcaaccctctggtggaaaagttcatggaaaacaagtgcttgaaccaagtgtttctgaaaataggacatggcctcaaaaaacagattttgctgatactgaggaagaagtcaaaggacctgagaagatcattaatgagcatgttgacaaaacagtagttcatccaaaggttaaacggaactctttgactgctagtctagacaaactcctgaaggaagcaactggaacttcaccctctcccttgcaagccaagttggcgcctgttatcactggaaccaactctaagctggaagaggggagattttttggaaaagggatagaacagagtcacaatacttcagctgataagagagaaatactagctccttttccagtgagagatgaaacttttggaaatacagctctcctcaagaaagctgaaagtggtgagtgccagctaagcacacagaatttgattcagatggctgcagaagattctcatccattggatccaacttcccagctttccagaaagggttcttttggggatgtggccagccctccccaagatatgctttttccccaggatgctcatcttgttccccaggctagggtacacccttctcaaacggaaatttcggagactgtagagaaagtcattcttccacccagacctgtattgaatgatgtaagtgctgcattacagaagctgtgtggagaagtatggttaagttatccagctggaagggaagtaggtcctggagaagtgaacccagaatttcctgaagcagtacagccagtatgtagccccctaaatcctccaggagtgatatcaccatgggctacgatggacaccatagttccagacaggaaggatttttattcctccaatgtagttcctgataaaactcatgaagttggatcttatttagctgcccaaatgtctccatcagaccagacgcttagctcatttgcttccattgttgctcaatatggcaaaggcctccctcaggaagtggaagaaattgtgagggaaacaattgttcaacccaaatcagagttcctcgaattcagtgctggcttagaaaaactactgaaggaagaaactgaaaccttcccctcaaaatatgaaagtgatacagggaatctttctccatcaaagttaataggtagtacagaggagcccaggcgagccacttctgaatgccatcctgaggaattaaaagaaacagtagaaaaggccgaggctccgttaataactgagagtgcttttgatgctggttttgagaaacttcttaaagaaataactgaagctcctccttatcagccccaggtgtcagtgagagaagaaactcacgagaaggagtcctcacagtcagagcagaccaggttcttggggacagtgccccatttttacagggcagcctcacagacctctgaaatgaaggataaaagtaatggtttggaatctcaagtcaaccaatgtgataaaatgttgggaggagacgcacttgtgactgatttattggtagatttttgtggttccagaagtggagttgagatccctagaaccccacaactttatgtggctcatgaaatagggaccattaaaactgtaacccccccagaggacagggacagtgaaagtggggttgcagggggacaagggactcttcaggaacctggctttggagaggcttctgaagcaattagtgtgtccagaaataggcaacccattcctctcctgatgaacaaagaaaactctacaaaaacaagtaaagttgaattgactctagcatcgccatatatgaaacaagagaaagaggaagaaaaagaaggtttctctgagtctgatttttcagatggaaacaccagttctaatgcagagagctggagaaatccttccagttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatct

SEQ ID NO: 30675 - DNA, 1943 bp, Homo sapiens
acagaagaatagagaggctgttgcagccccgtgctttctcctgctgctggccgattgcttgctctgaactaaccctctaacccttgggagtctgtgtgcagcagtgatgtgagctgcatccgggctgaaatgggagctcccgctatggcactggctcaaggagctaatctaaagagaaagtattttggggaagacatcttggttgcacccctcattgcatcttgactaattgcttccaactccgggggcttccagggacaatctcattgttcttttctctccaagggtcagccatgttaaccatttgttaatttcttctgaacagatcaagcaaaagtagataatcagccagaagaattagtgcgtagtgctgaagatgagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgat

SEQ ID NO: 30676 - DNA, 4275 bp, Homo sapiens
gggcgacacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggaggtaggtgatgctctgatgctgctgcctcttatgaattgacgacaggtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatct

SEQ ID NO: 30677 - DNA, 2733 bp, Homo sapiens
atgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatga

SEQ ID NO: 30678 - DNA, 633 bp, Homo sapiens
gcagaactctttgtaaaggcaggaagagtggagtgaattcctgggttaagttattcttctgtttgattctcaagtctcagcatttagatctctctgggcacaactggtaaaatcttaaattcaaaggaaagagtcccagaacaagggtgggaaatcgtgcctctgcttatataaataactaaatatagacagagggtgaagttgattctgaatataatggagccagaagatcttgaagcttgtcagtggatcagatgagaaaccagatcagaagccagttacaaatgaatgcgtaccaagaatgaaggtgctgaactttggcacatgacttgacaaattcttaagaactgcctaggaaagaagagagtccaggcttcagctctttttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggag

SEQ ID NO: 30679 - DNA, 6250 bp, Homo sapiens
atgattaacagttctttaagcatgctcttttcttatttagaaaagtatttctatgttgcagatgaactgtctcattgtgttgagcctgagccatctcaggtgccaggtggcagttctagagaccgtcagcaaggtaagccccctcctctcccggctctaaaagctaagacatcttcacgttctggtccatatgccactgagataaagaagtcaactgatgattccatatttaaagttctagactggtttaaccgaagttcttattcagatgacaataagtcattcctccaacatccccgaggaatagagtccaaagaaaaaacagactcaaaatcacaggttgctgttgacttggtgacagatgacactactttaagagaaaatggctcaaagaccctatcacccagcaaaattgaattgaagcctgtgagatctgactcaccattccaagcagagggagatatgctggtttctgaaagttgccaagataataatgtgaatatcaaatccaaattcatgaatttgtcccaaaaaggcaccccaaaggaaggcccaggtatattgcaaccatttgaaagctatggcaccccaagtcaagggagtaaaaatatggactatagccaagattcaaaaagcccaggaaaagggaatggggcatctccttcaaatagtaactattcctacagtgttctcaaggaatctgatgcagaaaaccaagttccatgcaacactaataatattggcaacttgggtgaagaagaacccaagtttcatgctcatgaagaaaatagaggacactcagaagtgaattttgactcttcaacagttgtcaaagaaccaggtttgaaagataacatgaatgcagagagaaagagcaaagtaggaaatacctatatcctgaaagcctccttagagccagagaatattaagtcaacacctggggttgccaacaatggctctccttggaagaagcctgaggtccaattccagcaagaagctggtgaggttcccaagaaccaagtgcagagagagaaatacaaaagagtgagtgacagaatatccttttgggaaggagagaaagctggtgctaagataactcatgaaaaacccacatcttcatgtagccaggaacaaccttctgctaaagcatatcagcctgtgaagaagtcacagggtgtatcatccatggacagtttatctacagaccagagtgaatataatcaggccattcccaaacgagtggtcttagatgaggatgatcaagcatcccagctctccaattcttattcctcaaataaatctaaagagaccaagccacaaatagcaggtccatccagatactatctttcagctgagcaatcagataaagtgtctctgtttcagaataagaaaaatgagcctataaaaagatcacaagtggcagacagtttgccttctagaagaaacattactttaccagcactgcaacctccctcaaatgtcgggagtgaacgacatgctccattggagaaagacagacctctagttcgtgaatcaaatgccaactttaaagttatgtccctaaaagaaagaatggatgaacccaatgcagaacaggtctataatccctctcagtttgagaatttgagaaagttttgggacttagaagctaattcaaacagtaaggataatgacaagaatattaccaccacaagccaaaaaaattctgcaccttttaataggcagaaacacaaggaattcagcgacattaaattatcaggtaaaaatacccatgaagcagaggtgcttctaagcccaaaaaaagttatggcaagagaggaaatggagaaattaaattcaaagggcatactccaggtgctaccagatgaaatcacatttcctttgagtccacttagaaagtatacttatcagttgccaggaaatgagtcatcaaaggaaaatgtggaaaagaatacggaagggattgttactccagtgtttaaggaagaaaaggattactcagaacaagagattcaagaatccataataaaaaccaatgttttgtctaaagactgcaaagacacttttaatgacagcttgcagaaactgctttcagaaacctcaacaccagcaattcaaccctctggtggaaaagttcatggaaaacaagtgcttgaaccaagtgtttctgaaaataggacatggcctcaaaaaacagattttgctgatactgaggaagaagtcaaaggacctgagaagatcattaatgagcatgttgacaaaacagtagttcatccaaaggttaaacggaactctttgactgctagtctagacaaactcctgaaggaagcaactggaacttcaccctctcccttgcaagccaagttggcgcctgttatcactggaaccaactctaagctggaagaggggagattttttggaaaagggatagaacagagtcacaatacttcagctgataagagagaaatactagctccttttccagtgagagatgaaacttttggaaatacagctctcctcaagaaagctgaaagtggtgagtgccagctaagcacacagaatttgattcagatggctgcagaagattctcatccattggatccaacttcccagctttccagaaagggttcttttggggatgtggccagccctccccaagatatgctttttccccaggatgctcatcttgttccccaggctagggtacacccttctcaaacggaaatttcggagactgtagagaaagtcattcttccacccagacctgtattgaatgatgtaagtgctgcattacagaagctgtgtggagaagtatggttaagttatccagctggaagggaagtaggtcctggagaagtgaacccagaatttcctgaagcagtacagccagtatgtagccccctaaatcctccaggagtgatatcaccatgggctacgatggacaccatagttccagacaggaaggatttttattcctccaatgtagttcctgataaaactcatgaagttggatcttatttagctgcccaaatgtctccatcagaccagacgcttagctcatttgcttccattgttgctcaatatggcaaaggcctccctcaggaagtggaagaaattgtgagggaaacaattgttcaacccaaatcagagttcctcgaattcagtgctggcttagaaaaactactgaaggaagaaactgaaaccttcccctcaaaatatgaaagtgatacagggaatctttctccatcaaagttaataggtagtacagaggagcccaggcgagccacttctgaatgccatcctgaggaattaaaagaaacagtagaaaaggccgaggctccgttaataactgagagtgcttttgatgctggttttgagaaacttcttaaagaaataactgaagctcctccttatcagccccaggtgtcagtgagagaagaaactcacgagaaggagtcctcacagtcagagcagaccaggttcttggggacagtgccccatttttacagggcagcctcacagacctctgaaatgaaggataaaagtaatggtttggaatctcaagtcaaccaatgtgataaaatgttgggaggagacgcacttgtgactgatttattggtagatttttgtggttccagaagtggagttgagatccctagaaccccacaactttatgtggctcatgaaatagggaccattaaaactgtaacccccccagaggacagggacagtgaaagtggggttgcagggggacaagggactcttcaggaacctggctttggagaggcttctgaagcaattagtgtgtccagaaataggcaacccattcctctcctgatgaacaaagaaaactctacaaaaacaagtaaagttgaattgactctagcatcgccatatatgaaacaagagaaagaggaagaaaaagaaggtttctctgagtctgatttttcagatggaaacaccagttctaatgcagagagctggagaaatccttccagttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaa

SEQ ID NO: 30680 - DNA, 2727 bp, Homo sapiens
tttaaccattctaactttgccttgggatattgaaaattctgaatcagtgaggtatctaaataatttatattttcaaaaaataatgtttattttataattctgagtgtaaaacactatcagaaaagtaatcctcatgctcactaaacaaacctactctaagacactcaacaaccagaacagttttattattgagttgtgtacaaaaatcttgactgtccagatgaaatagtttttcagcctgcagtgtgttagtgatatatctcaaggagatgaaccaataaagtacagactttgtggtctgaagctctgttgtgaaaaaataagctaaaccaattcacactgacagtataatttgattcaagtgcagctccagttcaataaaaactaatgtttttaaaattaactttgttttgtatttggttcaactccttgctagttctctctctatataatttataaaaactgcatgttgctaatctcatgatcctgtgcatgtggactactctgcctttaacttttttacaaaaacatgtttgttcatagattaaataaaagtatgttttcaacttaatgtctaatgttttctgacaattgtaagaataattttgaaatggaaatgctgctgtttagtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaa

SEQ ID NO: 30681 - DNA, 740 bp, Homo sapiens
cctgcacgctcccttccaaatactgatacccactctcacactagcctgccaagattccacttagcagctggtccccagttacatctcttcagttgacttcccaagcaagcctcccagaggcatatgtgaatgatgatgcacacacacaaatatttgttaatgaccatgggtttgggaaggtgttagtcatggctagcatcataccctttacagaagaatagagaggctgttgcagccccgtgctttctcctgctgctggccgattgcttgctctgaactaaccctctaacccttgggagtctgtgtgcagcagtgatatcaagcaaaagtagataatcagccagaagaattagtgcgtagtgctgaagatgtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaa

SEQ ID NO: 30682 - DNA, 3049 bp, Homo sapiens
agtgccgggcgacacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaa

SEQ ID NO: 30683 - DNA, 683 bp, Homo sapiens
atatttgttaatgaccatgggtttgggaaggtgttagtcatgatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaag

SEQ ID NO: 30684 - DNA, 3536 bp, Homo sapiens
ggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagac

SEQ ID NO: 30685 - DNA, 711 bp, Homo sapiens
ctcaagtctcagcatttagatctctctgggcacaactggtaaaatcttaaattcaaaggaaagagtcccagaacaagggtgggaaatcgtgcctctgcttatataaataactaaatatagacagagggtgaagttgattctgaatataatggagccagaagatcttgaagcttgtcagtggatcagtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaat

SEQ ID NO: 30686 - DNA, 1910 bp, Homo sapiens
gtgctttctcctgctgctggccgattgcttgctctgaactaaccctctaacccttgggagtctgtgtgcagcagtgatgtgagctgcatccgggctgaaatgggagctcccgctatggcactggctcaaggagctaatctaaagagaaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgat

SEQ ID NO: 30687 - DNA, 2425 bp, Homo sapiens
gaaacagtagaaaaggccgaggctccgttaataactgagagtgcttttgatgctggttttgagaaacttcttaaagaaataactgaagctcctccttatcagccccaggtgtcagtgagagaagaaactcacgagaaggagtcctcacagtcagagcagaccaggttcttggggacagtgccccatttttacagggcagcctcacagacctctgaaatgaaggataaaagtaatggtttggaatctcaagtcaaccaatgtgataaaatgttgggaggagacgcacttgtgactgatttattggtagatttttgtggttccagaagtggagttgagatccctagaaccccacaactttatgtggctcatgaaatagggaccattaaaactgtaacccccccagaggacagggacagtgaaagtggggttgcagggggacaagggactcttcaggaacctggctttggagaggcttctgaagcaattagtgtgtccagaaataggcaacccattcctctcctgatgaacaaagaaaactctacaaaaacaagtaaagttgaattgactctagcatcgccatatatgaaacaagagaaagaggaagaaaaagaaggtttctctgagtctgatttttcagatggaaacaccagttctaatgcagagagctggagaaatccttccagttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgat

SEQ ID NO: 30688 - DNA, 583 bp, Homo sapiens
ataaaccctaggcactgggggtatgaagataatgatacacatgtctaccctcagggccacaatattttaaataataatttcccaacagtctttggatatgctaatagggcttaatgaggaaagcagctaaacggaggagccattagatagaaaaccaatgtgctgatggctaaaagtcagtgacatgtagtgggaaacctgaaactttgcttatgaggtcctcctgccagcagtgaaggtgctgaactttggcacatgacttgacaaattcttaagaactgcctaggaaagaagagagtccaggcttcagctctttttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagt

SEQ ID NO: 30689 - DNA, 1441 bp, Homo sapiens
aaccctctaacccttgggagtctgtgtgcagcagtgatgtgagctgcatccgggctgaaatgggagctcccgctatggcactggctcaaggagctaatctaaagagaaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattac

SEQ ID NO: 30690 - DNA, 2335 bp, Homo sapiens
gagggtgagaagggccggctgccggagctgggttgcgatcttcccggagccggagaccctcccttgaaaccggcactgggacttctcgatctctggaggcacctgttgcaagtgacaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagcagcatgcaaagtggctcctccatgagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccatatgtgaagacttaccttctgcctgacaagtcccgccaaggaaaaagaaaaaccagcatcaagcgggacactattaatccactatatgatgagacgctgaggtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaagatcagtgctgagtccccgactggcttgccatcacacaaaggcgagttggtggtttcattgaaatacatcccagcctccaaaacccctgttggaggtgaccggaaaaagagtaaaggtggggaagggggagagctccaggtgtggatcaaagaagccaagaacttgacggctgccaaagcaggagggacttcagacagctttgtcaagggatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactgggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatgagtccctgtcctcttctgcaggtccagccctggcgagggcaggtcagaggaagtgaagaaatcaagagcaaagatttataatttaatgtgtatgtgtgtatgtgtgtatgtgtgtgtgtgtgtgtgtgtgtg

SEQ ID NO: 30691 - DNA, 3737 bp, Homo sapiens
agtcaccttttcgtgggttcctctcacagcgctcggccgtcgagcggggtcgctaacccgcactctcttcggacctacgacatcgcggcttctctggcgttggccagtcagccacaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagcagcatgcaaagtggctcctccatgagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccatatgtgaagacttaccttctgcctgacaagtcccgccaaggaaaaagaaaaaccagcatcaagcgggacactattaatccactatatgatgagacgctgaggtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaagatcagtgctgagtccccgactggcttgccatcacacaaaggcgagttggtggtttcattgaaatacatcccagcctccaaaacccctgttggaggtgaccggaaaaagagtaaaggtggggaagggggagagctccaggtgtggatcaaagaagccaagaacttgacggctgccaaagcaggagggacttcagacagctttgtcaagggatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactgggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatgagtccctgtcctcttctgcaggtccagccctggcgagggcaggtcagaggaagtgaagaaatcaagagcaaagatttataatttaatgtgtatgtgtgtatgtgtgtatgtgtgtgtgtgtgtgtgtgtgtgtatgtgtacaaacatgtattttctgcaaatctcattatgctggctagagtgatgcagacttgttcttctttttaaagcagtctcaagaataagcatttctttaaaatgtttctgtgtataatctagtttattttcagagtccattttttcttatgtctttataaggttcacttaacttaaaaacagcttttaaaacaactttttatcttctgtcttgctatcattgttcctacttccctaggaagccctggctacctttcgcattaggaccagtctgggttttaaggctctgggaagcagggttggttagtaaagacaggaatgttggggagaggtgagtagttccttcctctttctcctctccaatttatgcttttaacttattttctacctggataaacttctggaacttggcttttaaatttaacttttctagtttttaagcagtttccaccttgctttggtctaatgcttttctttgaaatgctaacagaattcccaagctttttccagttctagatatctttactagacctttgggggactcttataatggagctgcttttgaaaagcactttaattagataatgtattttgactaaatcacgaggatgcccagtgagagcttctagctgatctcagaggaccagagtgactgagggtaaagtgtctcacagcccatgctgaattttctgcattttaaactgatactgcagtcattggagagagagctcctcatttctcgaatgaaagatgagatatattcatcctcatgtaccacatctgtcttagtgtttgcgtctggggtgtgttatcaaacagagcatggtctacatcccactgtgtcaaccagaagagccaagtgttatctcaattggcccagtgtttctccaggctggggactgttaagggctctaagggaatgtagacagagtctccctgttattctgacttcctgcttgatgagctttcagttcctgtttttgctattgtttcctaaatttgacctacatattacatgggtgtagtgtgttgaggcttttcaaagaagggtctagtgagctaagtttcatcttctggtactcattgatcaaactgacctttctattctcataagcgtttctacccaaagttgtgtgtggaaggagtgtatagcagagaggaaatccctttcaacagagtcagctgctaactgatttcctataagcacactggattaagggcagccacagtggtttctactgtatgtatgaaccgaatggaggaatgttttcaaagattgatttggtgtggattgcaattgtaatggaaggcataacttgggatcccgggctgtaacttgctcttttgtttcccacccccctgacatgtatgtgtgctttaataaagctttctcacttgtc

SEQ ID NO: 30692 - DNA, 4847 bp, Homo sapiens
agggtgagaagggccggctgccggagctgggttgcgatcttcccggagccggagaccctcccttgaaaccggcactgggacttctcgatctctggaggcacctgttgcaagtgacaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagcagcatgcaaagtggctcctccatggtaagttctattagatctgtggttacaggcatgttggggtactaggaagaaaagaagcacctccctagagcagattcgggacctggggaaaccatcctagtcactcttttcaggtaagtaagatcatttgtttgttcctatcctcaatttagactataggtgcttagtgtacatctaggtgacttcctgagcccccacctggagattattacattacagcttgggacatttttcatcacagctttgtgaacaataaccttaacttatcctctaaaggggtacccaggctatgaagtgagcaagatcagatttcttcatcatagcccattccaaattctcaacattaaaagaaagtgagtgtcatgagaggggctctggcagggttgatcgacatcagggtatggttaacaagcaataataccagtcaggataatgaatttaaagggaacatttaagaatcagggcctggttctgtcataagcatgaagattgatatttagggaaacaggaacaagggtgaacagaatttgttcacactcacacacaggaagagaatgtcagctcgcatgaccgattactaccagaaaggaaggtgccttttcacttctggtggggtttcctccctcccactcactcccagttctggccaaatctcttttctctgtaggccctgataagacataaggtggataagagaaacccacagataattaaggcaccttgttttagttagtaactaacccccttctagctggtgttttagtgtatataacacattccccagatggacttaactgcaccttgcctctgctccctgcccacctcctggggcaggtgaaaatgaacactaaaatttgtaaaaagagttgaggaagagaagctaagaggctaggtgagccatgagctgattcattcacctgaacaattttgagtgctggtagttctctcttaccctctgggtcaaggaatgtcagcagcactggcttattgcaggggcttctgaaacttctgttcagtgactgtggttttatcatgagggaagatgtgagcaatgcgggcgggggagtgtgccttccccagatgttcgtgggtgctttatcttcagagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccgtgagtgcttctggaacctgactgatgctctgagaccagagaccagaccccggcatctgtccgggcactcttgaacagagcttatctgtttctgggggagcagggaggtgtaatgtaggaaaagaaccaggattgggaaaaagcaagaatggcatgtctaagagggcttgaggtgacatttttgacatcacatgtcaccatggcatatctatatggagaggaggaaagtgaaaagcaggcttgagaaaggccagcaaattactcagtgctgtctttggtttctagatatgtgaagacttaccttctgcctgacaagtcccgccaaggaaaaagaaaaaccagcatcaagcgggacactattaatccactatatgatgagacgctgagggtaagtatctagacctcaagggtaggagaacttgttctgtcttgtgccctaagctgtagctattcctctgcaacatgaccaggtgacacgggcttcagtgggccatgtctgtgtctgaggatacattgggtatctgttcacatcctgatctcccagtgaagagaacaaaggtgatctgcctttcctggattgatgtgaagtttgagattcacatggccacaaatctcatgtaaaaaagacatttgagataaggagtctccttggcagttctttttggacaatccagtgttatctcatccacttaagaaaaaatgaattttccaggtcctcctatggaatatggtaggtttttataaaatgagttaagttgaggctttgagtgaggaaactcaaagtgctcagggaacataaagtaatttggtattcaggactagtgacttcaggaatggttgctcaggttttggaataatcttgtctgaagaattacccttaactaatcatcttgggcttttactttcccttcacagtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaaggtagtctgctttaacaactcctgcagtttggatctgaggtagaattgtctgcagtagcctctgctggtctatgttggtagcgtctttgaatgtagtcttctctggagttctagtgccccctgctggtgtttctgagtttgacagcaatttcagaggcatttgtctatcaagtgtgagttctgtgtaaaccaggcaaagtgtgaagccatggttttgctttgaaaaaattttcatatgtgtaccaaactttgtctcctaaccttccagaatctgggtgtatcctaacatcctaactcgcacctcttctccgagctaaccttctgtgtatatcctaatctgtacccttttgccaagccactgctttacttccaagtgggaagtaaagcaattcatggagctccaattgctatgctcttggttacagaggccagggaaatattactttggagatggcacctcgggccacagtgtagcagtatggcataatcatgcctgggatctgagtgcagacctgtgttggaatcctggttctgtcacttgccaactagatgagtcacttaactacaaaataatgtagggaaatcatctggctaagaagaaatagctaaaacagaggacttattcagcaacttcttgattatcagaactacacaatgacatgacaaagttcatcttatttttttttacactagcgttttaaatgtgggatggttttacatggtccatagactttgggaagttagatgagaaactagtcatggtggctgcctctaggaatggagactgaggtagaaggaatatttagttttctctatatcccctttttaagcatttgaactttttaccatattaagaaaattaagcaaaaatggacttatgtacacatgattcaaaattaaaacaacataaagtatattaaaaggaaagtaggttccattccttagaaataaccagtgttaacactacttgtgtatccttctagaaattttttatggctaggtatggtggctcacgcctgtaatcccagcacattgggaggcggaggcaggcagatcacctgaggtcaggagttcgagaccaccctgaccaacatggtgaaaccccgtctctactaaatacaaaaaaattagctgggcatggtggcgcaagcctgtaatcccagctacttgggaggctgaggcaggagaatcgcttgaacccatgaggcggaggttgcagtgagccgagattgcgcctttgcactccagcctgggcaaaagagtgaaactctgtctcaaaaaaaaaaaaaaaaaaa

SEQ ID NO: 30693 - DNA, 3885 bp, Homo sapiens
cacagcgctcggccgtcgagcggggtcgctaacccgcactctcttcggacctacgacatcgcggcttctctggcgttggccagtcagccacagggaactagtaaaaaaagaaaaagaaaaaataaagtgaaagaggcgtgttgtctagtttcaaaggagaggagagaagagactgagtcgccctgtgttgcccaggctggtcttgaactcctaggctcaagagatcctcctgcctcagcctcccaaagtgctgggattacaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagcagcatgcaaagtggctcctccatgagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccatatgtgaagacttaccttctgcctgacaagtcccgccaaggaaaaagaaaaaccagcatcaagcgggacactattaatccactatatgatgagacgctgaggtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaagatcagtgctgagtccccgactggcttgccatcacacaaaggcgagttggtggtttcattgaaatacatcccagcctccaaaacccctgttggaggtgaccggaaaaagagtaaaggtggggaagggggagagctccaggtgtggatcaaagaagccaagaacttgacggctgccaaagcaggagggacttcagacagctttgtcaagggatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactgggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatgagtccctgtcctcttctgcaggtccagccctggcgagggcaggtcagaggaagtgaagaaatcaagagcaaagatttataatttaatgtgtatgtgtgtatgtgtgtatgtgtgtgtgtgtgtgtgtgtgtgtatgtgtacaaacatgtattttctgcaaatctcattatgctggctagagtgatgcagacttgttcttctttttaaagcagtctcaagaataagcatttctttaaaatgtttctgtgtataatctagtttattttcagagtccattttttcttatgtctttataaggttcacttaacttaaaaacagcttttaaaacaactttttatcttctgtcttgctatcattgttcctacttccctaggaagccctggctacctttcgcattaggaccagtctgggttttaaggctctgggaagcagggttggttagtaaagacaggaatgttggggagaggtgagtagttccttcctctttctcctctccaatttatgcttttaacttattttctacctggataaacttctggaacttggcttttaaatttaacttttctagtttttaagcagtttccaccttgctttggtctaatgcttttctttgaaatgctaacagaattcccaagctttttccagttctagatatctttactagacctttgggggactcttataatggagctgcttttgaaaagcactttaattagataatgtattttgactaaatcacgaggatgcccagtgagagcttctagctgatctcagaggaccagagtgactgagggtaaagtgtctcacagcccatgctgaattttctgcattttaaactgatactgcagtcattggagagagagctcctcatttctcgaatgaaagatgagatatattcatcctcatgtaccacatctgtcttagtgtttgcgtctggggtgtgttatcaaacagagcatggtctacatcccactgtgtcaaccagaagagccaagtgttatctcaattggcccagtgtttctccaggctggggactgttaagggctctaagggaatgtagacagagtctccctgttattctgacttcctgcttgatgagctttcagttcctgtttttgctattgtttcctaaatttgacctacatattacatgggtgtagtgtgttgaggcttttcaaagaagggtctagtgagctaagtttcatcttctggtactcattgatcaaactgacctttctattctcataagcgtttctacccaaagttgtgtgtggaaggagtgtatagcagagaggaaatccctttcaacagagtcagctgctaactgatttcctataagcacactggattaagggcagccacagtggtttctactgtatgtatgaaccgaatggaggaatgttttcaaagattgatttggtgtggattgcaattgtaatggaaggcataacttgggatcccgggctgtaacttgctcttttgtttcccacccccctgacatgtatgtgtgctttaataaagctttctcacttgtcaaa

SEQ ID NO: 30694 - DNA, 3743 bp, Homo sapiens
agtcaccttttcgtgggttcctctcacagcgctcggccgtcgagcggggtcgctaacccgcactctcttcggacctacgacatcgcggcttctctggcgttggccagtcagccacaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggtagaagaggaagaagaagaagaagacattgaccacctagtgaagttacatcgccagaagctagccagaagcagcatgcaaagtggctcctccatgagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccatatgtgaagacttaccttctgcctgacaagtcccgccaaggaaaaagaaaaaccagcatcaagcgggacactattaatccactatatgatgagacgctgaggtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaagatcagtgctgagtccccgactggcttgccatcacacaaaggcgagttggtggtttcattgaaatacatcccagcctccaaaacccctgttggaggtgaccggaaaaagagtaaaggtggggaagggggagagctccaggtgtggatcaaagaagccaagaacttgacggctgccaaagcaggagggacttcagacagctttgtcaagggatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactgggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatgagtccctgtcctcttctgcaggtccagccctggcgagggcaggtcagaggaagtgaagaaatcaagagcaaagatttataatttaatgtgtatgtgtgtatgtgtgtatgtgtgtgtgtgtgtgtgtgtgtgtatgtgtacaaacatgtattttctgcaaatctcattatgctggctagagtgatgcagacttgttcttctttttaaagcagtctcaagaataagcatttctttaaaatgtttctgtgtataatctagtttattttcagagtccattttttcttatgtctttataaggttcacttaacttaaaaacagcttttaaaacaactttttatcttctgtcttgctatcattgttcctacttccctaggaagccctggctacctttcgcattaggaccagtctgggttttaaggctctgggaagcagggttggttagtaaagacaggaatgttggggagaggtgagtagttccttcctctttctcctctccaatttatgcttttaacttattttctacctggataaacttctggaacttggcttttaaatttaacttttctagtttttaagcagtttccaccttgctttggtctaatgcttttctttgaaatgctaacagaattcccaagctttttccagttctagatatctttactagacctttgggggactcttataatggagctgcttttgaaaagcactttaattagataatgtattttgactaaatcacgaggatgcccagtgagagcttctagctgatctcagaggaccagagtgactgagggtaaagtgtctcacagcccatgctgaattttctgcattttaaactgatactgcagtcattggagagagagctcctcatttctcgaatgaaagatgagatatattcatcctcatgtaccacatctgtcttagtgtttgcgtctggggtgtgttatcaaacagagcatggtctacatcccactgtgtcaaccagaagagccaagtgttatctcaattggcccagtgtttctccaggctggggactgttaagggctctaagggaatgtagacagagtctccctgttattctgacttcctgcttgatgagctttcagttcctgtttttgctattgtttcctaaatttgacctacatattacatgggtgtagtgtgttgaggcttttcaaagaagggtctagtgagctaagtttcatcttctggtactcattgatcaaactgacctttctattctcataagcgtttctacccaaagttgtgtgtggaaggagtgtatagcagagaggaaatccctttcaacagagtcagctgctaactgatttcctataagcacactggattaagggcagccacagtggtttctactgtatgtatgaaccgaatggaggaatgttttcaaagattgatttggtgtggattgcaattgtaatggaaggcataacttgggatcccgggctgtaacttgctcttttgtttcccacccccctgacatgtatgtgtgctttaataaagctttctcacttgtc

SEQ ID NO: 30695 - DNA, 3897 bp, Homo sapiens
agtcaccttttcgtgggttcctctcacagcgctcggccgtcgagcggggtcgctaacccgcactctcttcggacctacgacatcgcggcttctctggcgttggccagtcagccacagggaactagtaaaaaaagaaaaagaaaaaataaagtgaaagaggcgtgttgtctagtttcaaaggagaggagagaaggtaagtgtgattctcatttcctttttcactctctgtctaccttgggctctttgactcccatgactaccaagtgtatattatcaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagcagcatgcaaagtggctcctccatgagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccatatgtgaagacttaccttctgcctgacaagtcccgccaaggaaaaagaaaaaccagcatcaagcgggacactattaatccactatatgatgagacgctgaggtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaagatcagtgctgagtccccgactggcttgccatcacacaaaggcgagttggtggtttcattgaaatacatcccagcctccaaaacccctgttggaggtgaccggaaaaagagtaaaggtggggaagggggagagctccaggtgtggatcaaagaagccaagaacttgacggctgccaaagcaggagggacttcagacagctttgtcaagggatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactgggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatgagtccctgtcctcttctgcaggtccagccctggcgagggcaggtcagaggaagtgaagaaatcaagagcaaagatttataatttaatgtgtatgtgtgtatgtgtgtatgtgtgtgtgtgtgtgtgtgtgtgtatgtgtacaaacatgtattttctgcaaatctcattatgctggctagagtgatgcagacttgttcttctttttaaagcagtctcaagaataagcatttctttaaaatgtttctgtgtataatctagtttattttcagagtccattttttcttatgtctttataaggttcacttaacttaaaaacagcttttaaaacaactttttatcttctgtcttgctatcattgttcctacttccctaggaagccctggctacctttcgcattaggaccagtctgggttttaaggctctgggaagcagggttggttagtaaagacaggaatgttggggagaggtgagtagttccttcctctttctcctctccaatttatgcttttaacttattttctacctggataaacttctggaacttggcttttaaatttaacttttctagtttttaagcagtttccaccttgctttggtctaatgcttttctttgaaatgctaacagaattcccaagctttttccagttctagatatctttactagacctttgggggactcttataatggagctgcttttgaaaagcactttaattagataatgtattttgactaaatcacgaggatgcccagtgagagcttctagctgatctcagaggaccagagtgactgagggtaaagtgtctcacagcccatgctgaattttctgcattttaaactgatactgcagtcattggagagagagctcctcatttctcgaatgaaagatgagatatattcatcctcatgtaccacatctgtcttagtgtttgcgtctggggtgtgttatcaaacagagcatggtctacatcccactgtgtcaaccagaagagccaagtgttatctcaattggcccagtgtttctccaggctggggactgttaagggctctaagggaatgtagacagagtctccctgttattctgacttcctgcttgatgagctttcagttcctgtttttgctattgtttcctaaatttgacctacatattacatgggtgtagtgtgttgaggcttttcaaagaagggtctagtgagctaagtttcatcttctggtactcattgatcaaactgacctttctattctcataagcgtttctacccaaagttgtgtgtggaaggagtgtatagcagagaggaaatccctttcaacagagtcagctgctaactgatttcctataagcacactggattaagggcagccacagtggtttctactgtatgtatgaaccgaatggaggaatgttttcaaagattgatttggtgtggattgcaattgtaatggaaggcataacttgggatcccgggctgtaacttgctcttttgtttcccacccccctgacatgtatgtgtgctttaataaagctttctcacttgtc

SEQ ID NO: 30696 - DNA, 3147 bp, Homo sapiens
ggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatctggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaa

SEQ ID NO: 30697 - DNA, 3291 bp, Homo sapiens
ttcagcccctctcccgggctgcgcctccgcactccgggcccgggcagaagggggtgcgcctcggccccaccacccagggagcagccgagctgaaaggccgggaaccgcggcttgcggggaccacagctcccgaaagcgacgttcggccaccggaggagcgggagccaagcaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatctggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggc

SEQ ID NO: 30698 - DNA, 3751 bp, Homo sapiens
agaaaagctacatacgtctctcgtttcttcactaattgttctctagaaaagggaaagtgaagaagggaaagagaaaagacaacggggaagaaaagagcatagaggagagaggaaaagtggggagagaaaggaagaaaaggactgagaaaacgcaggagccctggcttgccggtgagcagagccggcgcagccacagcgcggagccgcggcgcccactggtcctcggagctgccaatcggcgtgtaatcctgtaggaatttctcccgggtttatctgggagtcacactgccgcctcctctccccagtcgcccaggggagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcgagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttttgatcaaatgtacatctcccctttgctaacggccgtctgctctcaaggatgacgtgggtttgatttctaagtgtttcacagtgtctgtaaatcaagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaggagggtaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaattacagagggtaggaatgggtatacctctaactgtgcaaagcagagtgaaattcaattcatagaataacaactgctgggaatatccgtgccaggaaaagaaaaatttctggcaaatattttgtcactgctgtaaagcaaaatatttgtgaaagtgccaaaataaagtctgtcatgccaaaagtaaa

SEQ ID NO: 30699 - DNA, 1583 bp, Homo sapiens
agatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcggtgagagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgc

SEQ ID NO: 30700 - DNA, 1318 bp, Homo sapiens
gtctttgttccagagcatttgccaaagccaggtatgtccagtcaaagggataatgcaaccgatagctcccaagcctccatatcctcagctgttgcttgttgccactgaggggtggacatgttttcatttggcatcttacatgtgagcatcatgactacagactcatcttataccaattaaataataaactccactctgtgggcagaggttctgtctggagagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtat

SEQ ID NO: 30701 - DNA, 677 bp, Homo sapiens
gcaccaactccgtgtcgggagtgcagaaaccaacaaagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcat

SEQ ID NO: 30702 - DNA, 2116 bp, Homo sapiens
agatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcgagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattg

SEQ ID NO: 30703 - DNA, 1473 bp, Homo sapiens
agatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggcttcgttttgccctggttgcaagcagcggctgggagcagccggtccctggggaatatgcgggtggcctgcgtgtcggcggagtcgagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtat

SEQ ID NO: 30704 - DNA, 6392 bp, Homo sapiens
gcccagcgctggcgcagtgagaacttcgagagacccgtggacctggagggctctggggatgatgactcctttcccgatgatgaactggatgacctctactcggggtcgggctcgggctgtaagtacccccctccctacctctgcctgggggcagtgaccagtctgtatccagcctcaactctgagaagcccacggggggcttgcttcagtgaggcagggggcattcactgcctgggtcaggcaagttcttcttgctctggatccccagaacaagaagggcagaacatccttctggggatagaacaagacctgggaggacctcagggcccagaatgtccaggtctccagggtcccacgtctgcatctttgtgtgtgctatgtggctttctctgcagaccttgcttggttccggtggtcccgtcaggtgcaataagctgtggccaatggtggggttagggcagtgatgacacagggcaggtgcttcaagtggtgcctgggatggccccgccctggggaaggggagccaggtcagctgggtctagcagaatctcgggagagaagggcaccgcgaaccccactctgccatgtagcaactgtgtgcccctcggtgctccccctccctgaatccctgtattttcacctgtggatggtgagaaatacgacttcttctcagtgcctctaggagggtttgggataggaagctggggtctggcacagaggaggagctctcaaaatggtagcaaaaagaaggcagctgagactgggcccagtgagggcacgggctggcatctgaggagatggtacggggtctgcacgccacagagctggctccccacagccctcgcctctggtctcccctccttagccaagtcctttgagcctctttcaaattaatctttgtaaaacccgtttatattgggtcacatctctattcgcaaagttccctggctcccctccctcctgcctggttccgagcccaggagctggctgtggcttctccctcccccatcccctactccccatctcatttcctcccaagttccttcactgtcccggctttgcgtcagccagattgctcaagcagttcccctgcctcaagggcttcttttcccttttaccctccgcctctgcctctgggggaagcccttagtgtaccacccctgccttgagcttgtggtaggggtgcctttggggtctgactcttcccagaatgccactcctgtgttcccctgcaagccccagcaagttttgcagccagtagcgcctcagttgctgctgcctggattcaacctcatagaaactgtaggctgggtgggcaggaatagtcaaggaaggcttcccgggagaggcggcccccagaatttttgacttggcagagagaagttggggaacatcagcaactgaccacctttagctgggctgtgccttcctcctttctctcatcttttctgggaaaattgggtaaagagagggggttgggagacctaatcttgatggccattgcttacctgggatcctcatgcccctcacaaccacccagctccctagctctctccctctcccccaccccctcagacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagcctgggactgggcctggaacctggccccagttcttctctgccctctctcccaaggtctgcccaggctgccagcctcacacagatcttccccgaggaagaggggctgctgccatctgccccagactgtgcccttacgagctcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccgccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcacccctacctgcttcctccccaccgcagctggcagagggggaggtttggggccagacccccactagctgggagcctgggggctcctctaaggctgaggaaggaaatttggccccaggttgttggggggtcttgggtctcccaggacggaaggcccagggcagggagggggcatgtggttgggctcctttatctccctgtgtccccttcctgctttgagctagggggctgactctgcctcccaggacacaagtctccaaagtgcctgtgagggcgggccctccgcaccctctgccctctgcctggcaggccaacctcagcccacctgcccagaggccctccctgtggacaccccctcacctatttggccaaacaattctggctgcagcttcaggggccatggctggaagcagcccctgcagatccctcaggccccgaggtcagggtttgagggatgagaccaggtgatagtgggggaggggttacttcctttgttacctagcaagtagggctatttccatcggtattttaaatgtggggtcacagatcttttggggagggtgtgcttggcagggggcctcttggagccaaagggatgtggtgtgagttgcgattggctggcactcacacccccacccctcacccacatcccagattcaagtcaggaaggcaggttttatttcagggcccttttcaagatgccctggcagcagatttctgcaggatgaggggtagcggtgtgtaggcagtgagggggaggttccaggggctgtcccacagcctgtcttttccaggctgggctccatcttccagtcccaaaaccctccttcacagggcccagaggcttgtgaggaagccaggtggacccagccttagaagagtgggcatggggggcccctgatatctggagggggcgggttggcctcagtcatctttggagcagaagggctgggtcctggggccacagaccacaaggctcagcctccctaccctgctccctggggtgctgctgtcttggagagcacagctctggtgagacggcctgggcaggccgaggctgagaaaccagggaggatagaggagaaaagggcttgggcccccagccccagaagatgctggaccccaggtgggagacccaacagtgggtgcagtttctcagtagggctggagccaatggtgggggtggccccggcaggcctggctcctcacatcccaggggttggcttctgatttggggcttgggctccaggcactggcttctcttctctgtgtccttagcatttgagagaagaggccaggggccttgttcatggatccctggacccaaggcagatgtccaggctttatcctcctgaggatgaggagtctgaccagcccaaatctgccctggccggcctgaccggggcaaggcagtccaagagagttcagtgaggaccagctaggctctcccaggtgcaatgtgggtgcagggccctcatgtccccctacccctgcctgtgatggagtgttctgaggggctttggcatttgctggaagcacagggagttccaaatgagagggagcttctgtggcttgagagcctctggggccttggctgccagagcacgaggcaggccaggacctggagagcccagaccctgtctccaggaggccaggaggccagatgggggccttgcctgaaagactggtccccttgatcgctggaggcatgtgggtggcaaccagggctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttttttttttttttttttttttgtttgtttgtttttttaacacttcctgtgctgtgcccatttataagaggaaataaaattaagctgaaatg

SEQ ID NO: 30705 - DNA, 1580 bp, Homo sapiens
gctgtgggcgcggagctgcgaggcggagccgggcggccgagccgggagcccgcgagcctagagcgcgtcggtccagccgccgggccgcgccgccgccaagcagccgccccgcgcgccgcgcctcgggaacaaaggcgcccgcccgccgcccgccgcccgcgcccgcgccgccgccatgaagccggggccgccgcaccgtgccggggccgcccacggggccggcgccggggccggggccgcggccgggcccggggcccgcgggctgctcctgccaccgctgctgctgctgctgctggcggggcgcgccgcgggggcccagcgctggcgcagtgagaacttcgagagacccgtggacctggagggctctggggatgatgactcctttcccgatgatgaactggatgacctctactcggggtcgggctcgggctacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagc

SEQ ID NO: 30706 - DNA, 2613 bp, Homo sapiens
actcgccgcagcctgcgcgccttctccagtccgcggtgccatggcccccgcccgtctgttcgcgctgctgctgttcttcgtaggcggagtcgccgagtcgatccgagagactgaggtcatcgacccccaggacctcctagaaggccgatacttctccggagccctaccagacgatgaggatgtagtggggcccgggcaggaatctgatgactttgagctgtctggctctggagatctggatgacttggaagactccatgatcggccctgaagttgtccatcccttggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagcttgcttgtgggcactggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtactttctaaa

SEQ ID NO: 30707 - DNA, 1286 bp, Homo sapiens
actcgccgcagcctgcgcgccttctccagtccgcggtgccatggcccccgcccgtctgttcgcgctgctgctgttcttcgtaggcggagtcgccgagtcgatgacttggaagactccatgatcggccctgaagttgtccatcccttggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagcttgcttgtgggcactggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaat

SEQ ID NO: 30708 - DNA, 3048 bp, Homo sapiens
gggggtggggagtgttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcctctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaa

SEQ ID NO: 30709 - DNA, 2841 bp, Homo sapiens
gcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggacttttatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcctctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaac

SEQ ID NO: 30710 - DNA, 3052 bp, Homo sapiens
agggggtggggagtgttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcctctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaa

SEQ ID NO: 30711 - DNA, 3049 bp, Homo sapiens
agggggtggggagtgttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttgggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcctctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaac

SEQ ID NO: 30712 - DNA, 3144 bp, Homo sapiens
ttgtggttggggtcgggacccgaaccttccccttgaggtctccggagtcggcacgcccctcagccccgccgcacgctttcggcctgtcagctggccggagacctcagacgccggtgcggccgctttgctcaagcctgggccctgcctgcgacgcccgcaactcctggtgctcacaggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcctctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaa

SEQ ID NO: 30713 - DNA, 4493 bp, Homo sapiens
cacgggctgagccccgcgccgccaccatgtccgtggccttcgcgtctgcccggccaagaggcaaaggggaggttacgcagcaaaccatccagaagatgctggacgagaaccaccacctgatccagtgcatcctggagtaccagagcaagggcaagacggccgagtgcacgcagtaccagcagatcctgcaccggaacctggtatacctggccacgatcgcagactccaaccagaacatgcagtccctgcttcctgccccgcccacgcagaacatgaacctgggccctggagccctgactcagagcggctccagccagggcctgcactctcagggcagcctgagtgacgccatcagcacgggcctgccaccctcctccctcctgcagggccagattggcaacgggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggtatgacgccgagcgcacaccactggcgtgagacagcgcttggtggtgtgatacttttggtgctgtgtatagtattgtatgtcggtacacggagaggtatcctttttttgtcccccgcccccttctcaatgtttctagctagctttgggggtcattttgtcatcagagcattctgtgcccagggacaggacagatctcgaggacaccacagtccacctgttcccgtcaacagacgttaggtctcattttcctcctcatgcagtgttgtagtgtgggttgtcaacttttctttaactggctacgccacagctggacacacatgcagcccctggagggcagcctcttcctgtgcctcgatggggtgggtgggagggcatcttctgtgcgttgggtcagtttctgttacgtaacgaaaaggataaacatctcccacgggagaggccacagatggccacttccagagcttgcccattgcctgtctctcgccaattccgtttatccaaaaaggtacatgtttttgtattaaaaagtaaacagggatcagtgactgtattccaaataaatatgaatccctaagggccgtggacaaattgcctaacccagggccagcggtattgctgaaggaaaggggcagctctctgggaagtgggccctcagagattactctggctttgacccttgtttagctgatggtcatttctgggattggaatatttaataagcccaattctaagttgataggtaattttaaatattcaaaccaaatcttcccaacagttggcaagttgtttattttatattatttcttccaggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaatc

SEQ ID NO: 30714 - DNA, 3657 bp, Homo sapiens
atgcagagtctaagcacagaggccagatacgtcccaagagtcccccagcacagagatcagataagtcccaggagtccccagcacggaggccagatatgtcccaggagtcccctgcacagaggccagatatgtcccaggagtcccccagcacggaggtaccagcagatcctgcaccggaacctggtatacctggccacgatcgcagactccaaccagaacatgcagtccctgcttcctgccccgcccacgcagaacatgaacctgggccctggagccctgactcagagcggctccagccagggcctgcactctcagggcagcctgagtgacgccatcagcacgggcctgccaccctcctccctcctgcagggccagattggcaacgggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttc

SEQ ID NO: 30715 - DNA, 3703 bp, Homo sapiens
agcgcagccggagtatccacctcgatgaccacgggctgagccccgcgccgccaccatgtccgtggccttcgcgtctgcccggccaagaggcaaaggggaggttacgcagcaaaccatccagaagatgctggacgagaaccaccacctgatccagtgcatcctggagtaccagagcaagggcaagacggccgagtgcacgcagtaccagcagatcctgcaccggaacctggtatacctggccacgatcgcagactccaaccagaacatgcagtccctgcttcctgccccgcccacgcagaacatgaacctgggccctggagccctgactcagagcggctccagccagggcctgcactctcagggcagcctgagtgacgccatcagcacgggcctgccaccctcctccctcctgcagggccagattggcaacgggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttc

SEQ ID NO: 30716 - DNA, 781 bp, Homo sapiens
cacgggctgagccccgcgccgccaccatgtccgtggccttcgcgtctgcccggccaagaggcaaaggggaggttacgcagcaaaccatccagaagtttttgaagaatgccggccagtcatcgagtgcccttggtttgggtacaaggtgcgttttcctaacttgcgggtctgaaagtgcgtccattcccccttcacgcctggttgcggtttcggcggactagaatttctacgcagaagtctccctcaggatcagaccgtagcccttccggaaacctccatgatgctggacgagaaccaccacctgatccagtgcatcctggagtaccagagcaagggcaagacggccgagtgcacgcagtgagtgcccgccatacaccggaacacttggagggtgtcatgcagagtctaagcacagaggccagatacgtcccaagagtcccccagcacagagatcagataagtcccaggagtccccagcacggaggccagatatgtcccaggagtcccctgcacagaggccagatatgtcccaggagtcccccagcacggaggtaccagcagatcctgcaccggaacctggtatacctggccacgatcgcagactccaaccagaacatgcagtccctgcttcctgccccgcccacgcagaacatgaacctgggccctggagccctgactcagagcggctccagccagggcctgcactctcagggcagcctgagtgacgccatcagcacgggcctgccaccctcctccctcctgcagggccagattggcaacg

SEQ ID NO: 30717 - DNA, 815 bp, Homo sapiens
taggcgggagcatccaatcaacttcgagagcgtaggccccacctatcgtgggtcgagttgcttggcggtcgtggttccggaggttcctcgggatgtcggtggccttcgtaccggactggctgaggggcaaggcggaagtcaatcaagagactatccagcggctccttgaggagaatgaccagctgatccgctgtattgtggagtatcagaacaagggccgcgggaacgagtgcgtgcagtaccagcatgtgttacatagaaatctcatttatttggctaccattgcagatgccagtccaaccagcacttcaaaagcaatggaataatctttcaaaagcaatagaataatcttccatttggctgtcgtgaggagtaattgaatgtaatccatctcttacaaaatggagacagggtctttaccaactcaactggttaaaacatgaatgaaacctctgtggctctttcgaaacgtgaaaatgtgaagaaagctactaacttagctgtattctcatgtaaatattttttaaataattaagcaaatccctcaataagttgagcccaggtgtcctctttcctgaacttggagcatgtttggataacaaagacatcactgggatgttcaagtctactttttagtttcaacctgaagaggaaactcagtaggtgttgggcaggaattggtgagattcctgacttgataccttgctaaatggacatgtaactgtgtgctccttcctatcagtttgtaaatgtggtccccctgactgctgttttcagattgctttgaaataaagcttatttttctataaaatact

SEQ ID NO: 30718 - DNA, 1047 bp, Homo sapiens
cctcacctcgcccggacggcggccttcggaagtcggcgcctgccagctacccgccgcctcctcagcaatcttagccgaccgggagggctcggcccaggtcaccggcagcccaggcgcaggcgggagcatccaatcaacttcgagagcgtaggccccacctatcgtgggtcgagttgcttggcggtcgtggttccggaggttcctcgggatgtcggtggccttcgtaccggactggctgaggggcaaggcggaagtcaatcaagagactatccagcggctccttgaggagaatgaccagctgatccgctgtattgtggagtatcagaacaagggccgcgggaacgagtgcgtgcagtaccagcatgtgttacatagaaatctcatttatttggctaccattgcagatgccagtccaaccagcacttcaaaagcaatggaataatctttcaaaagcaatagaataatcttccatttggctgtcgtgaggagtaattgaatgtaatccatctcttacaaaatggagacagggtctttaccaactcaactggttaaaacatgaatgaaacctctgtggctctttcgaaacgtgaaaatgtgaagaaagctactaacttagctgtattctcatgtaaatattttttaaataattaagcaaatccctcaataagttgagcccaggtgtcctctttcctgaacttggagcatgtttggataacaaagacatcactgggatgttcaagtctactttttagtttcaacctgaagaggaaactcagtaggtgttgggcaggaattggtgagattcctgacttgataccttgctaaatggacatgtaactgtgtgctccttcctatcagtttgtaaatgtggtccccctgactgctgttttcagattgctttgaaataaagcttatttttctataaaatactgatgtggaggtatagaagttttcatgtaataagtattccatttggttttcaagaataactgtgaggacttaaccataaagtatataaaaacaatactattatcattgccaacaaaa

SEQ ID NO: 30719 - DNA, 3341 bp, Homo sapiens
gagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgatttt

SEQ ID NO: 30720 - DNA, 3434 bp, Homo sapiens
gagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgatttt

SEQ ID NO: 30721 - DNA, 3434 bp, Homo sapiens; identical to SEQ ID NO: 30720

SEQ ID NO: 30722 - DNA, 1307 bp, Homo sapiens
agtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagaattctaggtggacagtttgt

SEQ ID NO: 30723 - DNA, 1548 bp, Homo sapiens
gacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaattt

SEQ ID NO: 30724 - DNA, 2304 bp, Homo sapiens
atctcggcagatgctccacggatttgcacgaactcccgagtcttgacctccctcccctctccgggctgccgggacaactcggggcggccactcttgccaggaggcatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttca

SEQ ID NO: 30725 - DNA, 1827 bp, Homo sapiens
acttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcaggtgagtccaaactattccagagttgcataaatttcaaacaacaaaaaaaattagtgtcgatcattcatcgtaatttaaaagagttgtttaaatctgtagtttggaagataacttttattctataaagtgcattcccgttgtctaataaatattcatagcttctaggtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcact

SEQ ID NO: 30726 - DNA, 1545 bp, Homo sapiens
acttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcaggtcatgaataaaccacatctgttagtatggtttggtcagtggtcctcagaaaatctcatgtcgtgcaaccatactaatactcaagcaaaggaaaacttgaaggcctagactgaaacaggtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacag

SEQ ID NO: 30727 - DNA, 1298 bp, Homo sapiens
tcctggagcaatgacattgcagaatattttctcctcctccagccacactttgtcaccaactgctgccaactcgccaccactgctgccgacctcgcaaccactgctttgtctctgaagtgagactgctcctggtgccatgaacggagacgacacctttgcaaagagacccagggatgatgctaaagcatcagagaagagaagcaaggcctttgatgatattgccacatacttctctaagaaagagtggaaaaagatgaaatactcggagaaaatcagctatgtgtatatgaagagaaactataaggccatgactaaactaggtttcaaagtcaccctcccacctttcatgtgtaataaacaggccacagacttccaggggaatgattttgataatgaccataaccgcaggattcaggttgaacatcctcagatgactttcggcaggctccacagaatcatcccgaagatcatgcccaagaagccagcagaggacgaaaatgattcgaagggagtgtcagaagcatctggcccacaaaacgatgggaaacaactgcaccccccaggaaaagcaaatatttctgagaagattaataagagatctggacccaaaagggggaaacatgcctggacccacagactgcgtgagagaaagcagctggtgatttatgaagagatcagtgaccctgaggaagatgacgagtaactcccctgggggatacgacacatgcccttgatgagaagcagaacgtggtgacctttcacgaacatgggcatggctgcggctccctcgtcatcaggtgcatagcaagtgaaagcaagtgttcacaacggtgaaacttgagcgtcatttttcttagtgtgccaagagttcgatgttagtgtttccattgtattttcttacagtgtgccattctgttagatactatccttataattgatgagcaagacatactgaatgcatatttcggtttgtgtatccatgcacctacgtcagaaaacaagtattgtcaggtattctctccatagaacagcactatcctcatctctccccagatgtgactactgagggcagttctgagtgtttaatttcagactttttcctctgcatttacacacacacacacacacacacgcacacacacacaccaagtaccagtataagcatctcccatctgcttttcccattgccatgcgtcctggtcaagcccccctcactctgtttcctgttcagcatgtactcccctcatccgattcccctgtatcagtcactgacagttaataaacctttgcaaacgttc

SEQ ID NO: 30728 - DNA, 1410 bp, Homo sapiens
ctcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggaaatagggaggcccaagaaaaggaagagagacgcggaacagctcatcggtggagcagtcagaacacacacaacattggtcgattcagtttgtcaacttctatgggtgcagttcatggtacccccaaaacaattacacacaacagggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttc

SEQ ID NO: 30729 - DNA, 1292 bp, Homo sapiens
actttctctctctttcgattcttccatactcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttc

SEQ ID NO: 30730 - DNA, 1232 bp, Homo sapiens
ctgattttctctttggattcttccaaaatcagagtcagactactccctgtgccatgaacggagatgacacctttgcaaggagacccacggttggtgctcaaataccagagaagatacaaaaggccttcgatgatattgccaaatacttctctaaggaagagtgggaaaagatgaaagtctcggagaaaatcgtctatgtgtatatgaagagaaagtatgaggccatgactaaactaggtttcaaggccatcctcccatctttcatgcgtaataaacgggtcacagacttccaggggaatgattttgataatgaccctaaccgtgggaatcaggttcaacgtcctcagatgactttcggcaggctccagggaatcttcccgaagatcatgcccaagaagccagcagaggaaggaaatgtttcgaaggaagtgccagaagcatctggcccacaaaacgatgggaaacagctgtgccccccgggaaaaccaactacctctgagaagattaacatgatatctggacccaaaaggggggaacatgcctggacccacagactgcgtgagagaaagcagctggtgatttatgaagagatcagcgatcctgaggaagatgatgagtaactccccttggggatatgacacatgcccatgatgagaagcagaacgtggtgacctttcacgaacatgggcatggctgtggacccctcgtcatcaggtgcatagcaagtgaaagcaagtgttcacaacagtgaaaagttgagcgtcatttttcttagtgtgccaagagtacgatattagcgtttccattgtattttcttgaagtgtgtcattctgttagatattaacattttcactgatgagcaagacatacttaatgcatattttggtttgtgtatccatgcacctaccttagaaaacaagtattgtcagttacctctgcatggaacagcattaccctcctctctccctagatgtgactactgagggcagttctgagtgtttaatttcagattttttcctctgcatttacacacacacacaaaccacaccacacacacacacacacacacacagacacacaccaagtaccagtataagcatctcccatctgcttttcccattgccatgcgtcctggtcaggcttccctcactctgtttcctggtcagcatgtactcccctcatccgattcccctgtagcagtcactgacagtaaataaacctttgcaaacgtt

SEQ ID NO: 30731 - DNA, 800 bp, Homo sapiens
ctctctctttcgattcttccatactcaagagtacgcacggtctgattttctctttggattcttccaaaatcagagtcagactactccctgtgccatgaacggagatgacacctttgcaaggagacccacggttggtgctcaaataccagagaagatacaaaaggccttcgatgatattgccaaatacttctctaaggaagagtgggaaaagatgaaagtctcggagaaaatcgtctatgtgtatatgaagagaaagtatgaggccatgactaaactaggtttcaaggccatcctcccatctttcatgcgtaataaacgggtcacagacttccaggggaatgattttgataatgaccctaaccgtgggaatcaggttcaacgtcctcagatgactttcggcaggctccagggaatcttcccgaagatcatgcccaagaagccagcagaggaaggaaatgtttcgaaggaagtgccagaagcatctggcccacaaaacgatgggaaacagctgtgccccccgggaaaaccaactacctctgagaagattaacatgatatctggtgtccttcagagatactgcaggttcggttccagaccactgcaataaagaaatagggaggcccaagaaaaggaagagagacgcggaacagctcatcggtggagcagtcagaagacacaaaacattaatcgattaagtttgtcatattctatgggtgcagttcctggtacccccaaaacaattacacacaacagggtgattatagtcaataataacttaattgtacttaaaaaaactaaaa

SEQ ID NO: 30732 - DNA, 799 bp, Homo sapiens
ataagcctctgctgcagaataccctgatgcgacagaagtctctctagagtttggaaacctttaccaacaatgaaaaattctgatgtattctctttcagttcaacgtcctcagatgactttcggcaggctccagggaatcttcccgaagatcatgcccaagaagccagcagaggaaggaaatgtttcgaaggaagtgccagaagcatctggcccacaaaacgatgggaaacagctgtgccccccgggaaaaccaactacctctgagaagattaacatgatatctggacccaaaaggggggaacatgcctggacccacagactgcgtgagagaaagcagctggtgatttatgaagagatcagcgatcctgaggaagatgatgagtaactccccttggggatatgacacatgcccatgatgagaagcagaacgtggtgacctttcacgaacatgggcatggctgtggacccctcgtcatcaggtgcatagcaagtgaaagcaagtgttcacaacagtgaaaagttgagcgtcatttttcttagtgtgccaagagtacgatattagcgtttccattgtattttcttgaagtgtgtcattctgttagatattaacattttcactgatgagcaagacatacttaatgcatattttggtttgtgtatccatgcacctaccttagaaaacaagtattgtcagttacctctgcatggaacagcattaccctcctctctccctagatgtgactactgagggcagttctgagtgtttaatttcagattttttcctctgcatttacacaca

SEQ ID NO: 30733 - DNA, 615 bp, Homo sapiens
ggattggctactttaaattcagagtacgcacacgccgatttgcccttttgattcttccacaatcagggtgagactgctcccagtgccatgaacggagacgacgcctttgcaaggagacccagggatgatgctcaaatatcagagaagttacgaaaggccttcgatgatattgccaaatacttctctaagaaagagtgggaaaagatgaaatcctcggagaaaatcgtctatgtgtatatgaagctaaactatgaggtcatgactaaactaggtttcaaggtcaccctcccacctttcatgcgtagtaaacgggctgcagacttccacgggaatgattttggtaacgatcgaaaccacaggaatcaggttgaacgtcctcagatgactttcggcagcctccagagaatcttcccgaaggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtg

SEQ ID NO: 30734 - DNA, 1322 bp, Homo sapiens
ccaggctctagggacagaaccttcccaaggcgggggggaggggagactctgattttcccgccgaaagcgtccccttggattggctactttaaattcagagtacgcacacgccgatttgcccttttgattcttccacaatcagggtgagactgctcccagtgccatgaacggagacgacgcctttgcaaggagacccagggatgatgctcaaatatcagagaagttacgaaaggccttcgatgatattgccaaatacttctctaagaaagagtgggaaaagatgaaatcctcggagaaaatcgtctatgtgtatatgaagctaaactatgaggtcatgactaaactaggtttcaaggtcaccctcccacctttcatgcgtagtaaacgggctgcagacttccacgggaatgattttggtaacgatcgaaaccacaggaatcaggttgaacgtcctcagatgactttcggcagcctccagagaatcttcccgaagatcatgcccaagaagccagcagaggaagaaaatggtttgaaggaagtgccagaggcatctggcccacaaaatgatgggaaacagctgtgccccccgggaaatccaagtaccttggagaagattaacaagacatctggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccattgccatgcgacctggtcaagcccccctcactctgtttcctgttcagcatgtactcccctcatccgattccgttgtatcagtcactgacagttaataaacctttgcaaacgttc

SEQ ID NO: 30735 - DNA, 2870 bp, Homo sapiens
aatcggcggcagtggcggcggcggcgcgttggagcctcaccaagagccgccgcccgcagcccgcgccggctcagcgcagtctcctcgctccgtgctcgcaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccat

SEQ ID NO: 30736 - DNA, 3435 bp, Homo sapiens
atttttaaaaccacgaaatggcagggtacttcatgctgcgtttttaaggagaaagaaaaatctcttcttatggatgtcctgtaaggaaaacaaaaattaaagatgatgtaaaaggtggagccatcttcccgagtatcggatttgtgtttgcttttctgttggcaacaagccttgtgtaccaggatattaacgaataattaagatcctgtccagaagaggagggattttaaagataattgtgtgtgagctatcaggaaataactgttccaggtatagggttcaactttgtgaggagacaagaaaacaagtcagactgtcacagctaatttagggaaagcaaaatggaagtctgaaggctatcaagtaagccagagtgtggtgttaataaagagcctttgggaggcagaagcttgaatgtgatagaagtcagggtgggaaggtgagtcaggaccagcatagggaagtaggatggccttccagctagtgagtggaggtgtgtatatgtgtgtgtgtgtgtgtgtgtgtgtgccacacagacatgtgctattcagtagattagaaaggttaactcattggaagagttttgaagctcatttcagcaactgagataagaaggactactctgtgaagactcaatactcagaaatgtgatttcttagaaattgatccttgaaggaaccgacaggagttaagagagggaaacgcgtttccttttgttttcttttttgatgtccaattttgagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccataaaa

SEQ ID NO: 30737 - DNA, 2776 bp, Homo sapiens
cccatcaggatatttaagctggaagctttgtcaggctgcgtcagtgttccctgagtaagcaggaatgcaaactgcaattttagcattagcattctacttagaacaaagggaggtgcccggaagcagtacacattagtgcagagttttctggtttccctttaaagagaaggcacagccatttgactcttgagcttatttaaacaagtcaccagtccttgactccagaactgaagctttatatgttctttctatttggctgagccagtaatttttgattgcttcttcttcccaagagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctccc

SEQ ID NO: 30738 - DNA, 2983 bp, Homo sapiens
accacacacacaaaaaaatctcacgatgccccagaatgcagtttctttccttcgtgacgtgttgtgaagcacgtcagctgctccttgttgctgtgcagatcacccaacattaggtcaccgagagagacagcagctcttgctcacacagctgataggattaggagatggtgctttgtcagccctgattgagcccaagaaaaccccctgcatacacaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctccc

SEQ ID NO: 30739 - DNA, 3223 bp, Homo sapiens
agcggcttcttcaagaaacagatcctgcagcataatctgccagggccctggcaacaggaaccggtccttcaggcagcgagcccagggagcagaatcctggcgcccccggcgcgcggccctcagcgtgctcacgccgctgcgccccacccagcggtgcctgccctttggtcccccgcccttctctccattttgtcctcagccccagcagccgcccggctggctgcagaggccgaggggccgagggcaccggagcgcaagggattccgcggcaccacgtgtccaagccgggctaaggcgggcggagcgggccgggcccggctccccgggcctgagcgcaaaccagcagcgacgcggggtcccgtccgcaccggcacccggcccagccggggcccggtctcccgggcgcacgtaggtgcctcctcctggacagcgcgatggggcccttctgggcgagaaagggtgcctcctcctggacggcggcagcggcggcgcgaggagccggcgggcagcggcgcgatggggcccctccgcgagagcaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctccc

SEQ ID NO: 30740 - DNA, 3226 bp, Homo sapiens
agcggcttcttcaagaaacagatcctgcagcataatctgccagggccctggcaacaggaaccggtccttcaggcagcgagcccagggagcagaatcctggcgcccccggcgcgcggccctcagcgtgctcacgccgctgcgccccacccagcggtgcctgccctttggtcccccgcccttctctccattttgtcctcagccccagcagccgcccggctggctgcagaggccgaggggccgagggcaccggagcgcaagggattccgcggcaccacgtgtccaagccgggctaaggcgggcggagcgggccgggcccggctccccgggcctgagcgcaaaccagcagcgacgcggggtcccgtccgcaccggcacccggcccagccggggcccggtctcccgggcgcacgtaggtgcctcctcctggacagcgcgatggggcccttctgggcgagaaagggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctccc

SEQ ID NO: 30741 - DNA, 3104 bp, Homo sapiens
accacacacacaaaaaaatctcacgatgccccagaatgcagtttctttccttcgtgacgtgttgtgaagcacgtcagctgctccttgttgctgtgcagatcacccaacattaggtcaccgagagagacagcagctcttgctcacacagctgataggattaggagatggtgctttgtcagccctgattgagcccaagaaaaccccctgcatacacaggcatcaacaaatattgactggatcatctggacctgacttagctgccctttggaaagttctgttcaatcagctggatagagctgtttgttttcctcacctaaccctcacagctatcctagaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctccc

SEQ ID NO: 30742 - DNA, 3072 bp, Homo sapiens
actcaggctgaagggaccgattggagtgctggcttgaactcgtttttctgagttcaattccagtgctcttcccttagcagtgtgctggagctacttcctggagccgggcagctgcagggcagcgctggggaaaagactgttctctggctacatagcagcctggcttctccaagccggagggagctgcgctgaccactgaaggcctttctgatgcaaccccttccaagtagaatccatcgcagcctttcagatcccggaacccagaggctgtgtcggtcctgacgcactggcttggctgggctccggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctccc

SEQ ID NO: 30743 - DNA, 2919 bp, Homo sapiens
agcacgtcagctgctccttgttgctgtgcagatcacccaacattaggtcaccgagagagacagcagctcttgctcacacagctgataggattaggagatggtgctttgtcagccctgattgagcccaagaaaaccccctgcatacacaggtgcctcctcctggacggcggcagcggcggcgcgaggagccggcgggcagcggcgcgatggggcccctccgcgagagcaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccataaaa

SEQ ID NO: 30744 - DNA, 748 bp, Homo sapiens
ctcttatgggaaaacaggcagctctctccctggtaagaaaaatatgggtctccaccccaccccaccacacacacaaaaaaatctcacgatgccccagaatgcagtttctttccttcgtgacgtgttgtgaagcacgtcagctgctccttgttgctgtgcagatcacccaacattaggtcaccgagagagacagcagctcttgctcacacagctgataggattaggagatggtgctttgtcagccctgattgagcccaagaaaaccccctgcatacacaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcag

SEQ ID NO: 30745 - DNA, 582 bp, Homo sapiens
tttctttccttcgtgacgtgttgtgaagcacgtcagctgctccttgttgctgtgcagatcacccaacattaggtcaccgagagagacagcagctcttgctcacacagctgataggattaggagatggtgctttgtcagccctgattgagcccaagaaaaccccctgcatacacaggcatcaacaaatattgactggatcatctggacctgacttagctgccctttggaaagttctgttcaatcagctggatagagctgtttgttttcctcacctaaccctcacagctatcctagaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcag

SEQ ID NO: 30746 - DNA, 559 bp, Homo sapiens
atttgactcttgagcttatttaaacaagtcaccagtccttgactccagaactgaagctttatatgttctttctatttggctgagccagtaatttttgattgcttcttcttcccaagaggcatcaacaaatattgactggatcatctggacctgacttagctgccctttggaaagttctgttcaatcagctggatagagctgtttgttttcctcacctaaccctcacagctatcctagagcccgcgccggctcagcgcagtctcctcgctccgtgctcgcaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagctt

SEQ ID NO: 30747 - DNA, 564 bp, Homo sapiens
ttaggagatggtgctttgtcagccctgattgagcccaagaaaaccccctgcatacacagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgag

SEQ ID NO: 30748 - DNA, 2636 bp, Homo sapiens
agcacgtcagctgctccttgttgctgtgcagatcacccaacattaggtcaccgagagagacagcagctcttgctcacacagctgataggattaggagatggtgctttgtcagccctgattgagcccaagaaaaccccctgcatacacagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccataaaa

SEQ ID NO: 30749 - DNA, 558 bp, Homo sapiens
atcaggaaataactgttccaggtatagggttcaactttgtgaggagacaagaaaacaagtcagactgtcacagctaatttagggaaagcaaaatggaagtctgaaggctatcaagtaagccagagtgtggtgttaataaagagcctttgggaggcagaagcttgaatgtgatagaagtcagggtgggaagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccg

SEQ ID NO: 30750 - DNA, 2995 bp, Homo sapiens
gcagtgtgctggagctacttcctggagccgggcagctgcagggcagcgctggggaaaagactgttctctggctacatagcagcctggcttctccaagccggagggagctgcgctgaccactgaaggcctttctgatgcaaccccttccaagtagaatccatcgcagcctttcagatcccggaacccagaggctgtgtcggtcctgacgcactggcttggctgggctccggtgcctcctcctggacggcggcagcggcggcgcgaggagccggcgggcagcggcgcgatggggcccctccgcgagagcaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccat

SEQ ID NO: 30751 - DNA, 565 bp, Homo sapiens
tatttaaacaagtcaccagtccttgactccagaactgaagctttatatgttctttctatttggctgagccagtaatttttgattgcttcttcttcccaagaggcatcaacaaatattgactggatcatctggacctgacttagctgccctttggaaagttctgttcaatcagctggatagagctgtttgttttcctcacctaaccctcacagctatcctagaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagat

SEQ ID NO: 30752 - DNA, 1126 bp, Homo sapiens
cggcttcttcaagaaacagatcctgcagcataatctgccagggccctggcaacaggaaccggtccttcaggcagcgagcccagggagcagaatcctggcgcccccggcgcgcggccctcagcgtgctcacgccgctgcgccccacccagcggtgcctgccctttggtcccccgcccttctctccattttgtcctcagccccagcagccgcccggctggctgcagaggccgaggggccgagggcaccggagcgcaagggattccgcggcaccacgtgtccaagccgggctaaggcgggcggagcgggccgggcccggctccccgggcctgagcgcaaaccagcagcgacgcggggtcccgtccgcaccggcacccggcccagccggggcccggtctcccgggcgcacgtaggtgcctcctcctggacagcgcgatggggcccttctgggcgagaaagggtgcctcctcctggacggcggcagcggcggcgcgaggagccggcgggcagcggcgcgatggggcccctccgcgagagcaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctg

SEQ ID NO: 30753 - DNA, 545 bp, Homo sapiens
agcagtgtgctggagctacttcctggagccgggcagctgcagggcagcgctggggaaaagactgttctctggctacatagcagcctggcttctccaagccggagggagctgcgctgaccactgaaggcctttctgatgcaaccccttccaagtagaatccatcgcagcctttcagatcccggaacccagaggctgtgtcggtcctgacgcactggcttggctgggctccggtgcctcctcctggacggcggcagcggcggcgcgaggagccggcgggcagcggcgcgatggggcccctccgcgagagcaagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacag

SEQ ID NO: 30754 - DNA, 516 bp, Homo sapiens
ttctacttagaacaaagggaggtgcccggaagcagtacacattagtgcagagttttctggtttccctttaaagagaaggcacagccatttgactcttgagcttatttaaacaagtcaccagtccttgactccagaactgaagctttatatgttctttctatttggctgagccagtaatttttgattgcttcttcttcccaagaggtgcctcctcctggacggcggcagcggcggcgcgaggagccggcgggcagcggcgcgatggggcccctccgcgagagcaagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagca

SEQ ID NO: 30755 - DNA, 573 bp, Homo sapiens
attctacttagaacaaagggaggtgcccggaagcagtacacattagtgcagagttttctggtttccctttaaagagaaggcacagccatttgactcttgagcttatttaaacaagtcaccagtccttgactccagaactgaagctttatatgttctttctatttggctgagccagtaatttttgattgcttcttcttcccaagagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccg

SEQ ID NO: 30756 - DNA, 2765 bp, Homo sapiens
ttttgtcctcagccccagcagccgcccggctggctgcagaggccgaggggccgagggcaccggagcgcaagggattccgcggcaccacgtgtccaagccgggctaaggcgggcggagcgggccgggcccggctccccgggcctgagcgcaaaccagcagcgacgcggggtcccgtccgcaccggcacccggcccagccggggcccggtctcccgggcgcacgtaggtgcctcctcctggacagcgcgatggggcccttctgggcgagaaaggatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccataaaataataa

SEQ ID NO: 30757 - DNA, 2645 bp, Homo sapiens
aatcggcggcagtggcggcggcggcgcgttggagcctcaccaagagccgccgcccgcagcccgcgccggctcagcgcagtctcctcgctccgtgctcgcaggtgcctcctcctggacggcggcagcggcggcgcgaggagccggcgggcagcggcgcgatggggcccctccgcgagagcaagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaa

SEQ ID NO: 30758 - DNA, 2498 bp, Homo sapiens
cccatcaggatatttaagctggaagctttgtcaggctgcgtcagtgttccctgagtaagcaggaatgcaaactgcaattttagcattagcattctacttagaacaaagggaggtgcccggaagcagtacacattagtgcagagttttctggtttccctttaaagagaaggcacagccatttgactcttgagcttatttaaacaagtcaccagtccttgactccagaactgaagctttatatgttctttctatttggctgagccagtaatttttgattgcttcttcttcccaagaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgttt

SEQ ID NO: 30759 - DNA, 575 bp, Homo sapiens
aattttgtactgcaggctttgctctagaatgtgcctcctcctggacggcggcagcggcggcgcgaggagccggcgggcagcggcgcgatggggcccctccgcgagagcaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatat

SEQ ID NO: 30760 - DNA, 3244 bp, Homo sapiens
agcacgtcagctgctccttgttgctgtgcagatcacccaacattaggtcaccgagagagacagcagctcttgctcacacagctgataggattaggagatggtgctttgtcagccctgattgagcccaagaaaaccccctgcatacacaggcatcaacaaatattgactggatcatctggacctgacttagctgccctttggaaagttctgttcaatcagctggatagagctgtttgttttcctcacctaaccctcacagctatcctagaggtgcctcctcctggacggcggcagcggcggcgcgaggagccggcgggcagcggcgcgatggggcccctccgcgagagcaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccataaaataataattatttctgtgattttacttctatgtataagaaagacaatgaatagcagatcttacatctttatcaatagggggtctgtaaaaattgaattaaattaggaagagggaaaaagagttagttattaaagaaaatgaagatttcctacccttacttaaaaagcatcatttctgaataaaagtagatttgtttacttttaaa

SEQ ID NO: 30761 - DNA, 582 bp, Homo sapiens
agcattagcattctacttagaacaaagggaggtgcccggaagcagtacacattagtgcagagttttctggtttccctttaaagagaaggcacagccatttgactcttgagcttatttaaacaagtcaccagtccttgactccagaactgaagctttatatgttctttctatttggctgagccagtaatttttgattgcttcttcttcccaagaggtgcctcctcctggacggcggcagcggcggcgcgaggagccggcgggcagcggcgcgatggggcccctccgcgagagcaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccc

SEQ ID NO: 30762 - DNA, 613 bp, Homo sapiens
tttctgatgcaaccccttccaagtagaatccatcgcagcctttcagatcccggaacccagaggctgtgtcggtcctgacgcactggcttggctgggctccggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgag

SEQ ID NO: 30763 - DNA, 559 bp, Homo sapiens
attttgtcctcagccccagcagccgcccggctggctgcagaggccgaggggccgagggcaccggagcgcaagggattccgcggcaccacgtgtccaagccgggctaaggcgggcggagcgggccgggcccggctccccgggcctgagcgcaaaccagcagcgacgcggggtcccgtccgcaccggcacccggcccagccggggcccggtctcccgggcgcacgtaggtgcctcctcctggacagcgcgatggggcccttctgggcgagaaagggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcag

SEQ ID NO: 30764 - DNA, 5533 bp, Homo sapiens
ggcggcccctgcagggcagctgaagccatggaagcctccgcaggtcgctgatcagggccaggcggctgcagcagcgactgcagaggcgctgcgccaagccgggccggagtggtgcgagccggcggggctgcggagggccagtggactcagggttgttgagaggagtcaatggcataatacgggaagccccgaaccacgggccaactgggaagttgatggtcggcgagaccagcccatcctaatttggggttcctggtcctgctccaggagtcctacagcctgcagcccctaccagagagggaggactgaacagcaagggggtgtgtgggtctgagtatcagggtcctggggaagaagcaggcctggctcgtagagtagaagactcggtgccggcagtcaggaggccctgctcctgaagcctctgtgaccttgggcacggccttcactctgtctggggcacattcactcatctggagaacacagggttggactgattacttttagccactcctgacagttgtggttttaagttgggtggtgggaacctgtgcaccagccctattcaattcactggtggaggcagccgtggtctgccaggccctcgctcctggggtgtcctgccgaagggtgagaagagaagccatgccgggcagcggccccagcgagaggatgacgtggcctggcccggccctttctgcgggccccccaacccgccctctctcctcagcccccgggataccgcccatcccaccccttactcggacccacagcctcatggccatgtccctgccaggaagtagacggacctctgctggatcacgcaggcgcacctctccacctgtgagcgtgcgggatgcctacggcacctcttcgctcagcagcagcagcaattctggctcctacaagggcagtgacagcagtcccacgccaaggcgctccatgaaatacacgctgtgcagtgacaaccatggcatcaagcccccgaccccggagcagtacctgacccccctgcagcagaaggaggtgtgcatccggcacctgaaagcccggctgaaggacacacaggaccggctccaggaccgggacacagagattgatgacctgaagacgcagctgtcacgcatgcaggaggactggattgaggaggagtgccaccgcgtggaggcccagctggccctgaaggaggcccgaaaggagatcaagcagctcaagcaggtcatcgacactgtcaagaacaacctgattgacaaggacaaggggctgcagaagtacttcgtggacatcaacatccagaacaagaagctggagacgctgctgcacagcatggaggtggcccagaatggcatggccaaggaggatggcactggggagtcagccggtgggtcccctgcccgctccctcacccgcagctccacctacaccaagctgagtgacccggctgtctgtggtgaccgccagccgggtgatccctccagcggctctgctgaggatggggcagacagtggctttgcagcagccgatgacacactgagccggacggacgcgctggaagccagcagcctgctgtcgtcgggggtggactgtggcaccgaggagacctcgctgcacagctccttcggcctgggcccccgcttccctgccagcaacacctatgagaagctgctgtgtggcatggaggctggtgtgcaggccagctgcatgcaggagcgtgccatccagacagacttcgtgcagtaccagcctgaccttgacaccatcctggagaaagtgacccaggcccaggtctgtgggacagaccctgagtcaggggacaggtgcccagagctggatgcccacccttcagggcccagagaccccaactcagcagtggtggtgacagtgggtgatgagctagaggccccagagcccatcacccgtggacccaccccacagcggcctggtgccaaccccaaccctggccagtcggtgagcgtggtgtgccccatggaagaggaggaggaggctgccgtggctgagaaggagcccaagagctactggagccgccactacatcgtggatctgctggctgtggtggtgccggccgtgcccacggtggcctggctttgccgctcccagcggcgccagggccagcccatctacaacatcagctccctgctgcggggctgctgcactgtggccttgcactccatccgcaggatcagctgccgctcgctgagccagccgagtcccagcccagcgggcggcggctcccagctctgagggggcccattctggcagcggcgcctgcggcctgaccactgattgtagggatgccgttcccccctcccttctcccatgggcatcatcttatttatttagttttgggtgtggaactgtttctttttttcaagatgttaaaacagtcccgtggaaggagcaggggttggagaaaggcatcccaaagcttcgatggagagcagggaagggggacccaaggcaggaggtacaccagctggacaaattgcagggaggggagggagcgagggccaacccggcccctctgtccccttggctcttcagacagggccagccctgctcaggaagtctctggctgtcttcatgtggggaagccgggcttgagttgcccataggcccctgccctgcaccatcctgtccagtgccctgcgcactccatgccgtctcttccaagccaccttgcccgcagcccaggctcctgggccagtgctctctcctcaaatggaggcagccatggcctgaagtgcagatcactgacccagggctcagagcagaggccagaaccactgggccggccggcattccagcctccccagactgctgcccaccttgggactcaggagctcagtcaaggccacaggctggaggagagacggggctgggcgcaaggtggcggagggcagtgtgggttctgtgtctgtctgttcatcccaggctttcccgtcatccctttcctcttggcacttctgggtgtgtcagtcattattcctgtgaggtagctaagcccggcaagctcagtgctggggtaggagggcctgcctgagtcccagctcccagctggagaatccaccagcacaagaagaggaggcaggggcagaaacccaagggggctcccccagccttccaaggtgaggccatctcatctgcaggctgggaggcagggctggactcaggaacccacagcttactgaaaaagccagaggccatgactgcccccagaaacttgccccgagtttctctggggccctcgggcccaacttctgctttgcactatgttcactttggggttggttctcagccatccaagggtctccagtgaggtggctgcttgctgtctgagatgagggttcctaaaccttaaacctctctgcctctggaggagggtggggtattctggcaggatgaatcgcaggatggcgcgtactgaagccacgatgttcatccaggccaaagcagggtgtcctgggataggtttcctaggcaggggcgtggcagagcaggtaggcgccctgcagcctccctgctcccagcccaaggccagtcggcctgggaagttcactgccccaactcttttcccgggaccatactgagtcccccagccacgctgctgacattaccattattattttaccaagtaaactcactccttttcccccacaggggttacacccatctggttgtcccacccactcttcagaggctaggccccacctctgggggttggagggaccctgtgtcttactcgcccctctggcctaagggccactctggttatctgccaaggttgcttgccctcaccccaatgctccaacagccattgcctaactcatgggctctgcccttctgctcggtgccctccacgtgaggcggggcacctgcatgcactgggagggggcggctggcccagccctcggggcaggagccccctctgccacacgctttgtgcctccaaagctccccccgccttggtcagggcctcagaccagccaacctttgtggaataagccccagcccagccaaaccaaacccagatgcctgaggcctggctggggctgcccccgcaggacactgtggccatgccacggagggggcagtggacaaaaccaatccaaagccaagccgggactggctgcggacccagcctcctgtgccgcgcactcacggagctgcgtagtctcctcagacatagtcaaagctttgccgagaaaagaaatgtatgaactatatttgacaacataaaatctctctatttttcaccactggaatttagtcaagcttcaggcccctctgctcctgtctgtgtcttgcgtctgtggccttcctattgtgtcttgtgttttggtggatgtgacagggctggggccacagtctactctgtctctgctgctagagaagccacctgtggaggactgggctgtggttgggcctgaggcctgtggaggaggtgagtgtagccagcagcggccgtctactcctgttctggcctgagaccaccggtgtgggtcacgagggccctggcccacagtgttgagggtcctctctttcgggggctctcctggggccttcgatgggcttttcttcttgtcagtggagggagcagctccccactcagccctgggacaggccctgggactgtggtggccggtggccctggcccagctctggagtgcatgtgtgtgtgctcagatcccgcatctatgcaaaggtgcaggctgcctgtgaggctccaggcggtggaggtgcggcagctgctgctcaggtgccatgccctgaagaggcagggtacacatggggctgggagggcaaagatggggcggggcctccccctgagagagctcaccctccacagtgacccttttccttcctgcctaatacctcctcccgttgggctgtgacttttcctcctgccctcagcctctgaaacagaaatctttggggcctcccctttccccagcgtctggcaagagctgatgaggtcctgaggaacagtgtccccaggaaccaccttctggagcctagcggccagacgtggcttctcctgagttctagggctcgggccagagtggcactactgcccggccagtccaggctcaggcaggaatcggacgctggggcccgggctctgcacagagagctgggcttgagtggagtttattgtagatttctcccaaggggatcacttagcttctcactgacacacccttcccaattgccacaagcgcaggggtatcttacagcactttggggaggggtgggacaaactgcaaggttctggggccaaggcctacccaggggcctctgcccagagaactcacaaccccctctctgacctgggggacaatgcaaacaggtcacagtgcattcccatattaggccatccccttcacgaagaattcaggggatgtgggaagtggggaggcggggagggatcttgactcttgtctcctttgtccttttgttcagacagagttgtacctgcagcagacaactctgaattaaagcatgaaaacacagcaag

SEQ ID NO: 30765 - DNA, 4995 bp, Homo sapiens
cagctagccgcctcctgcaggggctcgggagagcaattcggcggcccctgcagggcagctgaagccatggaagcctccgcaggtcgctgatcagggccaggcggctgcagcagcgactgcagaggcgctgcgccaagccgggccggagtggtgcgagccggcggggctgcggagggccagtggactcagcccccgggataccgcccatcccaccccttactcggacccacagcctcatggccatgtccctgccaggaagtagacggacctctgctggatcacgcaggcgcacctctccacctgtgagcgtgcgggatgcctacggcacctcttcgctcagcagcagcagcaattctggctcctacaagggcagtgacagcagtcccacgccaaggcgctccatgaaatacacgctgtgcagtgacaaccatggcatcaagcccccgaccccggagcagtacctgacccccctgcagcagaaggaggtgtgcatccggcacctgaaagcccggctgaaggacacacaggaccggctccaggaccgggacacagagattgatgacctgaagacgcagctgtcacgcatgcaggaggactggattgaggaggagtgccaccgcgtggaggcccagctggccctgaaggaggcccgaaaggagatcaagcagctcaagcaggtcatcgacactgtcaagaacaacctgattgacaaggacaaggggctgcagaagtacttcgtggacatcaacatccagaacaagaagctggagacgctgctgcacagcatggaggtggcccagaatggcatggccaaggaggatggcactggggagtcagccggtgggtcccctgcccgctccctcacccgcagctccacctacaccaagctgagtgacccggctgtctgtggtgaccgccagccgggtgatccctccagcggctctgctgaggatggggcagacagtggctttgcagcagccgatgacacactgagccggacggacgcgctggaagccagcagcctgctgtcgtcgggggtggactgtggcaccgaggagacctcgctgcacagctccttcggcctgggcccccgcttccctgccagcaacacctatgagaagctgctgtgtggcatggaggctggtgtgcaggccagctgcatgcaggagcgtgccatccagacagacttcgtgcagtaccagcctgaccttgacaccatcctggagaaagtgacccaggcccaggtctgtgggacagaccctgagtcaggggacaggtgcccagagctggatgcccacccttcagggcccagagaccccaactcagcagtggtggtgacagtgggtgatgagctagaggccccagagcccatcacccgtggacccaccccacagcggcctggtgccaaccccaaccctggccagtcggtgagcgtggtgtgccccatggaagaggaggaggaggctgccgtggctgagaaggagcccaagagctactggagccgccactacatcgtggatctgctggctgtggtggtgccggccgtgcccacggtggcctggctttgccgctcccagcggcgccagggccagcccatctacaacatcagctccctgctgcggggctgctgcactgtggccttgcactccatccgcaggatcagctgccgctcgctgagccagccgagtcccagcccagcgggcggcggctcccagctctgagggggcccattctggcagcggcgcctgcggcctgaccactgattgtagggatgccgttcccccctcccttctcccatgggcatcatcttatttatttagttttgggtgtggaactgtttctttttttcaagatgttaaaacagtcccgtggaaggagcaggggttggagaaaggcatcccaaagcttcgatggagagcagggaagggggacccaaggcaggaggtacaccagctggacaaattgcagggaggggagggagcgagggccaacccggcccctctgtccccttggctcttcagacagggccagccctgctcaggaagtctctggctgtcttcatgtggggaagccgggcttgagttgcccataggcccctgccctgcaccatcctgtccagtgccctgcgcactccatgccgtctcttccaagccaccttgcccgcagcccaggctcctgggccagtgctctctcctcaaatggaggcagccatggcctgaagtgcagatcactgacccagggctcagagcagaggccagaaccactgggccggccggcattccagcctccccagactgctgcccaccttgggactcaggagctcagtcaaggccacaggctggaggagagacggggctgggcgcaaggtggcggagggcagtgtgggttctgtgtctgtctgttcatcccaggctttcccgtcatccctttcctcttggcacttctgggtgtgtcagtcattattcctgtgaggtagctaagcccggcaagctcagtgctggggtaggagggcctgcctgagtcccagctcccagctggagaatccaccagcacaagaagaggaggcaggggcagaaacccaagggggctcccccagccttccaaggtgaggccatctcatctgcaggctgggaggcagggctggactcaggaacccacagcttactgaaaaagccagaggccatgactgcccccagaaacttgccccgagtttctctggggccctcgggcccaacttctgctttgcactatgttcactttggggttggttctcagccatccaagggtctccagtgaggtggctgcttgctgtctgagatgagggttcctaaaccttaaacctctctgcctctggaggagggtggggtattctggcaggatgaatcgcaggatggcgcgtactgaagccacgatgttcatccaggccaaagcagggtgtcctgggataggtttcctaggcaggggcgtggcagagcaggtaggcgccctgcagcctccctgctcccagcccaaggccagtcggcctgggaagttcactgccccaactcttttcccgggaccatactgagtcccccagccacgctgctgacattaccattattattttaccaagtaaactcactccttttcccccacaggggttacacccatctggttgtcccacccactcttcagaggctaggccccacctctgggggttggagggaccctgtgtcttactcgcccctctggcctaagggccactctggttatctgccaaggttgcttgccctcaccccaatgctccaacagccattgcctaactcatgggctctgcccttctgctcggtgccctccacgtgaggcggggcacctgcatgcactgggagggggcggctggcccagccctcggggcaggagccccctctgccacacgctttgtgcctccaaagctccccccgccttggtcagggcctcagaccagccaacctttgtggaataagccccagcccagccaaaccaaacccagatgcctgaggcctggctggggctgcccccgcaggacactgtggccatgccacggagggggcagtggacaaaaccaatccaaagccaagccgggactggctgcggacccagcctcctgtgccgcgcactcacggagctgcgtagtctcctcagacatagtcaaagctttgccgagaaaagaaatgtatgaactatatttgacaacataaaatctctctatttttcaccactggaatttagtcaagcttcaggcccctctgctcctgtctgtgtcttgcgtctgtggccttcctattgtgtcttgtgttttggtggatgtgacagggctggggccacagtctactctgtctctgctgctagagaagccacctgtggaggactgggctgtggttgggcctgaggcctgtggaggaggtgagtgtagccagcagcggccgtctactcctgttctggcctgagaccaccggtgtgggtcacgagggccctggcccacagtgttgagggtcctctctttcgggggctctcctggggccttcgatgggcttttcttcttgtcagtggagggagcagctccccactcagccctgggacaggccctgggactgtggtggccggtggccctggcccagctctggagtgcatgtgtgtgtgctcagatcccgcatctatgcaaaggtgcaggctgcctgtgaggctccaggcggtggaggtgcggcagctgctgctcaggtgccatgccctgaagaggcagggtacacatggggctgggagggcaaagatggggcggggcctccccctgagagagctcaccctccacagtgacccttttccttcctgcctaatacctcctcccgttgggctgtgacttttcctcctgccctcagcctctgaaacagaaatctttggggcctcccctttccccagcgtctggcaagagctgatgaggtcctgaggaacagtgtccccaggaaccaccttctggagcctagcggccagacgtggcttctcctgagttctagggctcgggccagagtggcactactgcccggccagtccaggctcaggcaggaatcggacgctggggcccgggctctgcacagagagctgggcttgagtggagtttattgtagatttctcccaaggggatcacttagcttctcactgacacacccttcccaattgccacaagcgcaggggtatcttacagcactttggggaggggtgggacaaactgcaaggttctggggccaaggcctacccaggggcctctgcccagagaactcacaaccccctctctgacctgggggacaatgcaaacaggtcacagtgcattcccatattaggccatccccttcacgaagaattcaggggatgtgggaagtggggaggcggggagggatcttgactcttgtctcctttgtccttttgttcagacagagttgtacctgcagcagacaactctgaattaaagcatgaaaacacagcaag

SEQ ID NO: 30766 - DNA, 1926 bp, Homo sapiens
cgcggcggcgcggagctcgggcggccgtggaggaactcagcctcggccgcaggaggcgccgggagcggagccgccgggagtcgcgcaacaggtttccttctccatcgctgcgcccacaggggacgcgcgccctgccgggagaggggcttctcggttcgcactctcgctcccagtccaggcaaaatgaaagaccggctagcagaacttctggacttgtccaagcaatatgaccagcagttcccagacggggacgatgagtttgactcgccccacgaggacatcgtgttcgagacggaccacatcctggagtccctgtaccgagacatccgggacattcaggatgaaaaccagctgctggtggccgacgtgaagcggctgggaaagcagaacgcccgcttcctcacgtccatgcggcgcctcagcagcatcaagcgcgacaccaactccatcgccaaggccatcaaggcccggggcgaggtcatccactgcaagctgcgcgccatgaaggagctgagcgaggcggctgaggcccagcacggcccgcactcggcagtggcgcgcatttcgcgggcgcagtacaacgcgctcaccctcaccttccagcgcgccatgcacgactacaaccaggccgagatgaagcagcgcgacaactgcaagatccgcatccagcgccagctggagatcatgggcaaggaagtctcgggcgaccagatcgaggacatgttcgagcagggtaagtgggacgtgttttccgagaacttgctggccgacgtgaagggcgcgcgggccgccctcaacgagatcgagagccgccaccgcgaactgctgcgcctggagagccgcatccgcgacgtacacgagctcttcttgcagatggcggtgctggtggagaagcaggccgacaccctgaacgtcatcgagctcaacgtacaaaagacggtcgactacaccggccaggccaaggcgcaggtgcggaaggccgtgcagtacgaggagaagaacccctgccggaccctctgctgcttctgctgtccctgcctcaagtagcaggccggcccgggccgccaccgcccatcccagaccatggagcgcgctgggaaggacgcaccaaagccgggagctctgccctgcagggagttgccccaaccctttccggaactcagtctttagaaaagaaacgccaggttcaagaattgcaaaccagcctgtgcttggaaagatggttagttgataccgtccgatgattcttcagtaaagatagattcccacaaagttgtgcaatgtcattatatgacaccttgcactcttaccgtcttgacagaagccaagtaaggaactgaagttgtatctgactgtagggtgaatgtctgaggcctgcctcctaataaagactcaaggaggaagtcaattgggcatctgctaatagaatgaactcatgatggaaacttcagttcatttactttgtcctgaaaattccctggttctgttccattttgagcgaaattggccttgggaaaaaccacgttcttcctttccgattcttcatccggtctacgctatgcaattcctccccaaatatagatcttatttctgctcatttcccctacttattaaaatcacaccaaacacttactattttcttatctctttcactttttaaatatctttcaccaggttatattttggtattatttttccaaacatttttaagcactgaatatcgaacaagcactcaaattgaagtatcagtcatgttttgtgtatttttcgctgataaaaattatttaacatttatatttttacttgattacatatgcacatgtatgtaaatgtaaaatactaatattcactaatatatgtacataatgatcaattggtttaacttcttttatgtaagtatggtatataaatttcaagacgaacact

SEQ ID NO: 30767 - DNA, 785 bp, Homo sapiens
agctgcagtcagatccggggatggagggagccggagaagaggagtgagaaggccggggaggcaggccctgctgtcttcctgcaggccggcagcctgctggcagtggaggaccaggccgtccaggaaaggaaggggtcaggagctgttagccgagcaacttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttag

SEQ ID NO: 30768 - DNA, 4897 bp, Homo sapiens
gagctgcagtcagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaa

SEQ ID NO: 30769 - DNA, 4329 bp, Homo sapiens
aggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagtgagtagtcacatcacctccagccctctgcattcacgtagcattgctgcgcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaa

SEQ ID NO: 30770 - DNA, 999 bp, Homo sapiens
agatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcagctgttagccgagcaagtgagtagtcacatcacctccagccctctgcattcacgtagcattgctgcggagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtga

SEQ ID NO: 30771 - DNA, 4897 bp, Homo sapiens
gagctgcagtcagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaacagttatcaaaacttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaa

SEQ ID NO: 30772 - DNA, 4213 bp, Homo sapiens
atggccaccaggcgtttaaccgacgctttcttgttgttgcggaataattccatccaaaaccggcagctgttagccgagcaagtgagtagtcacatcacctccagccctctgcattcacgtagcattgctgcggccctggatgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaa

SEQ ID NO: 30773 - DNA, 4552 bp, Homo sapiens
gcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaacttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaa

SEQ ID NO: 30774 - DNA, 1577 bp, Homo sapiens
agatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgctttcttgttgttgcggaataattccatccaaaaccggcagctgttagccgagcaagtgagtagtcacatcacctccagccctctgcattcacgtagcattgctgcgcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcac

SEQ ID NO: 30775 - DNA, 4937 bp, Homo sapiens
agatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagtgagtagtcacatcacctccagccctctgcattcacgtagcattgctgcggagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaa

SEQ ID NO: 30776 - DNA, 560 bp, Homo sapiens
agtcagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcagctgttagccgagcaagagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccac

SEQ ID NO: 30777 - DNA, 843 bp, Homo sapiens
tagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcaggcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatt

SEQ ID NO: 30778 - DNA, 855 bp, Homo sapiens
ggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttc

SEQ ID NO: 30779 - DNA, 553 bp, Homo sapiens
gagctgcagtcagatccggggatggagggagccggagaagaggagtgagaaggccggggaggcaggccctgctgtcttcctgcaggccggcagcctgctggcagtggaggaccaggccgtccaggaaaggaaggggtcaggagctgttagccgagcaagagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagctt

SEQ ID NO: 30780 - DNA, 812 bp, Homo sapiens
atggccaccaggcgtttaaccgacgctttcttgttgttgcggaataattccatccaaaaccggcagctgttagccgagcaagagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaag

SEQ ID NO: 30781 - DNA, 2708 bp, Homo sapiens
ctcgtgatgccccgccccgtcgctcctgcgcctgcgccgtgcccaccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggtaaaaagaaaagaaaaaaagaaatttcgagatattttcaacattgttagagtttgggctaaaatgagcaaggagaaaaaaaccaccaagaacatttcctggggcatgttccagttttgaggggtgatatatctgccagatagggggtatctgacccagtcttcttttcagctggtctctggggggagctgagaactcgcttgctacctcacatccttttccccagactttttatctcctatgcatccctttgctttctatagctggtgtttcttccccaaaatggcgttcccatgcttacctttctcacattctagacaatgatggacaaagacgcatgcaagactcagacccggggaatggtgtggtgctaatctcaacacctgacattcacagcaagcatggcccagcccaactgcatgtctatctcaaaccgcagaaaggctttaatactggaaaaaaagaattcaagactacaggcagctcccctctgtaccccaactcatttaaaataggaggaatcactttttgccttacttaacgcttttttctgagcacagggatgggcacctgcaccccagaaggtgtgagctgtctctctgccaggagctaaggttcattaggggattggatggtttatcacttctttctttctgagtttacttttagtaacttttattgatggctacctttcatgtccctgtctaaagagactttctctttcatacgtcttaaatctcatcaatgaaatccagtgaaacagcaccatttcttagtatcattaaataactagaaagt

SEQ ID NO: 30782 - DNA, 2523 bp, Homo sapiens
aaggggctctctggaggccgcctttgggggcgtcgggccctcacaggcttggtgggcctggcgcccgtgtggcgcgcgcaagaggcgctgggcggcaagtagggcattggatccgaagtgcgagcgccatggtggctcctcctgtttttcagaagtggcggagcctcgcttggtttcgtttttggaagctttattggaagctggtatagggaggccgcagacgatgcgagcaggacggcctcccggggtcgcggggtggaaaagtttccggcgcgcgtcctgtctctggcgcgctgtaggccccgggtcgccagggtcgctggcgtctgggtcccgggacagacccgcgcatccgttcgctggtgggggcgtttggtgtgtgtggcccaggtgtgctgtgggtgacactgcgaggaatgacgcgacgctcgatggtagtgaggctcggaggactgggagcgagaggccggaagcccctgctcgccaaacccagaggtggttggcagaaggtcccacaccttggctccctccttttagctaaccgaggttcagagaggagactttactttgacttttctctccaaattcggtatctcttccataagtcagaaacattaagcggcgggccggaagaaatcgggcgccactagtatcctgaaaagtgggagctctgggccgatggaaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggt

SEQ ID NO: 30783 - DNA, 542 bp, Homo sapiens
cgggccctcacaggcttggtgggcctggcgcccgtgtggcgcgcgcaagaggcgctgggcggcaagtagggcattggatccgaagtgcgagcgccatggtggctcctcctgtttttcagaagtggcggagcctcgcttggtttcgtttttggaagctttattggaagctggtatagggaggccgcagacgatgcgagcaggacggcctcccggggtcgcggggtggaaaagtttccggcgcgcgtcctgtctctggcgcgctgtaggccccgggtcgccagggtcgctggcgtctgggtcccgggacagacccgcgcatccgttcgctggtgggggcgtttggtgtgtgtggcccaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaag

SEQ ID NO: 30784 - DNA, 568 bp, Homo sapiens
accgaccggcctcgagcgccccggcgggagagatgggattttggcatgttgcccaggctggccatgaactcctgggctcaagtggtcctcccgccttggcctcccaaagtgctggtattacagacatgagccaccgtacccggccccttcattcacaatttttcataaagattcagtggctccacaaagtctgtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatt

SEQ ID NO: 30785 - DNA, 2424 bp, Homo sapiens
gggctctctggaggccgcctttgggggcgtcgggccctcacaggcttggtgggcctggcgcccgtgtggcgcgcgcaagaggcgctgggcggcaagtagggcattggatccgaagtgcgagcgccatggtggctcctcctgtttttcagaagtggcggagcctcgcttggtttcgtttttggaagctttattggaagctggtatagggaggccgcagacgatgcgagcaggacggcctcccggggtcgcggggtggaaaagtttccggcgcgcgtcctgtctctggcgcgctgtaggccccgggtcgccagggtcgctggcgtctgggtcccgggacagacccgcgcatccgttcgctggtgggggcgtttggtgtgtgtggcccaggtgtgctgtgggtgacactgcgaggaatgacgcgacgctcgatggtagtgaggctcggaggactgggagcgagaggccggaagcccctgctcgccaaacccagaggtggttggcagaaggtcccacaccttggctccctccttttagctaaccgaggttcagagaggagactttactttgacttttctctccaaattcggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggt

SEQ ID NO: 30786 - DNA, 2095 bp, Homo sapiens
gccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagggagagatgattgacaggatcgagtacaatgtggaacacgcggtagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacccttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtggccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtatctgtaccag

SEQ ID NO: 30787 - DNA, 783 bp, Homo sapiens
atgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagcctcagggtgctttcctgaagtcctgccccgagccccaacccaaccctgaggagggggccctctggagctcgggtgcccccggccccgcagggagagatgattga

SEQ ID NO: 30788 - DNA, 1774 bp, Homo sapiens
gtcgcgcatgcggggctcacacggctgcagccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagatcgagtacaatgtggaacacgcggtagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacccttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtggccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtatctgtaccagg

SEQ ID NO: 30789 - DNA, 2050 bp, Homo sapiens
agccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacccttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtggccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtatctgtaccag

SEQ ID NO: 30790 - DNA, 4539 bp, Homo sapiens
cggcgccccccggcgcccccagaccccggcctccggcacagaggcgggagacccggagcagcagcagaggcaggaggactaggaggaggaggaggagccgtcgcaggatgaaggatcggactcaagagctgcggagtgcgaaagacagtgatgatgaagaggaggtggtccacgtggatcgggaccacttcatggatgagttctttgaacaggtggaagagatccggggctgcattgagaaactgtcggaggatgtggagcaggtgaaaaaacagcatagcgccatcctggccgcacccaacccagatgagaagaccaaacaggagctggaggatctcactgcagacatcaagaagacggccaacaaggttcggtccaaattgaaagcgatcgagcaaagcattgaacaggaggaggggctgaaccgttcctccgcggacctgcgcatccgcaagacccagcactccacactgtcccggaagttcgtggaggtaatgaccgaatataacgcgacccagtccaagtaccgggaccgctgcaaggaccggatccagcggcaactggagatcactggaaggaccaccaccaacgaagaactggaagacatgctggagagcgggaagctggccatcttcacagatgacatcaaaatggactcacagatgacgaagcaggcgctgaatgagattgagacgaggcacaatgagatcatcaagctggagaccagcatccgcgagctgcacgatatgtttgtggacatggccatgctcgtagagagccagggagagatgattgaccgcatcgagtacaacgtggaacattctgtggactacgtggagcgagctgtgtctgacaccaagaaagcagtgaaatatcagagcaaggcccggaggaagaaaatcatgatcatcatttgctgtgtggtgctgggggtggtcttggcgtcatccattggggggacgctgggcttgtaggccccccccacccttctctctcccagacccttcccccaccacatcgggagcaatacccccaccacccctttcactccatcccctgctccaggctcactcccaaaacagacccaggcagccccacccccacggcagaccctggtgtccctggacctcaccgggccatggaccccccccccgtccccgcacgtagatcgcagcaggcgtgattacacatgcacaccaacatgcatgccgccggcacatgctcgagacgtgtggacaccccagcgtgcgtgtgcgtgtgatgtgtgtgatgcaccagagcaccccctccacccccaccttgggtgtgtgtgcgtggtctgagcttcccccttcaccggggctgttgtgtagactgcagccaagtgtaacacagcagtccatcacgccctctctgtcctctgtgaacagtgtgtgtgcgtgcgtgagaccacagatctgtggacacaccatttgtgtacgtggaattttgtgtttcagtgtttgaacctaatgcaacagcaacaaagccactgatacctgagccctttgtgtctgctacaaaccaggcaggtggtgtgtgtggactcacactcacattctcagaggatccagggaggcccaggtacacacaggccatggcagacaccccatgtctttgttaccccaggggctgtggcatgtcccaggagggtgtgcatgtgtgtgtgtgtgtgtgtgtgtgtgtccaggatgtgcctgaagtattgataggtcttctcagatagagccctccacactgtggactggacacctgttttgggagggcacagaaatgtgtatttcttgctacctagaatgcagctgtgtgtgtgtggcgtgcgtgtgtatgcacgtgtgtgtgtgtgttaggggctctctacatggtgtgctttttaatttttttttgttttttgttttttgtttttttcgagacggagtcttgctctgtcacccaggctggagtgcagtggcgcaatctcagctcactgcaacctgtgcctccctgacgcaagcgattctcatgcctcagcctcccaagtagctgggactacaggcgcctgccaccacgcctggctaattttagaattttagtagagatgaggttttgacatgttggccaggctggtctcgaactcctgacctcaggtgatccgcccactttggcctccctaagtgctggcattacaggcctgagccaccacgcctggcctacatgatgtgtttctgtcctgcctgacctacatggtgtgtttctgccctgcgtattacacacacacacacacacgtgcgtgcacacacacttctaaggacgtggccccatctggctttgtctctccagttgtccttgccctgcccccctccccagaggtgctgcccagtgctggtgtggccacacacggctacatcattgtgcaggcagagctccctgcctgcccagcctcagggctctgcatgctcacacctagatcctcatcttcctccatgtctctgcccagcatagccccgagcccctggaagctggtacccctcagtgtgctcacacgtggcaaggccgaggtggccccaggcaggggccataccaggcacaaaccatgcacgctggcatgggtgcggggatcacacgaatgcctcctggaaggaaagggctacttgtaggaatgttactgatgaggcaagatgccaaggacttccctgcagggatcaaagatcaggacacgaccccttcctcacacacccacctcagacctgggagaggactgtgtgtcccccactgccccatcggatgctctgggctctgcctcagggaactcgggtttggggaaatgtctatttcagaagtactggagtggccagtgtggcagtggccactcagggtgggctgggtcctgagacccatccccgacacctctcctgctgaaccctcaggctgctccccacaccagggtgtgactgaggggtacacaggcctggatttctggtgtgaggaaggggctagcacctcccctgttgtgtagccagcacaggcacaatttgtgggtttggtggcaggtaggtggtgcgtgggagaaaggacagtgttagaggtccccactccgtggtctaggatcatgaaaggtgaacacacaagtacacaaatgtgccatgccctggcatggggcttatgtgtgcacaggcaaggcactcggtgtgtgtgtgcggaccccagggtcccaggtcatgtgaagcgtacgtgtgtgtgcattgtatgtgtgtgtacattgtgtgtgcattgtgtgtgcatgtggccaaacagatgtgacctcccagaacacagtacccctccacctctacccgagctcagacagccgagctctcccttgtcctgtgtgtgtgtcagtgtggccacgtgcgtaaccccaggtgggctgtcctgagctgggggcctgcctgtcccttcccagaacgcccctctgcaggacaggaagtctgccccaagtctggccacggccctcctgctcccatctcgggctgcttgggagacatcagagcaggccccagcccccagtcccctcttccggccgcctggacaggacccccattcagcccaggtgtttccggaagtcccacggccttggggccacaggagaagggttgaagcgtggctggggcaccactccccccacctggagtggcattgggcccacagctgcccatctctgggcctcaggtggaccaggggatctctaagggtctgctgtgccctttctatgcgtcctccacatcctatgatgtgcctgcttgttggctgctgtctgtgtgcgtcctggcatgttgtctggaggctggtgtcttttgcatgttcttggacaaatgtgtgctacctgcccaggcgcctgcaaccattgagcccacatgtgccccacgtgtgccctgcgggtggtcccgggcctggccagggctcagtgctcctcttccccctcctccctgttcccacccctcatgaagcacactgcgtgtccatcccatgtacccgtgggtcgacacacgctcttgccacgccctgagcgtgtacacatgatgtgttctatgcattcaccctgccccccagcccgccctgcagaggacaagatgggtggccccggctccctttcccctaaccgcccctgcccgctgtgcagccgtgtgcgttggcgtgtgtttctgtgtcactggcgtgtcacgtgatgtagccgtgtttgctgacatgagcccctgcccccttctctgtttctccgttggtttctagagctctctccctccccttctcagaggggacaggactcctggggcctggctggggcccagagccaggccgccctctcctgttagccctcagagtcccatttctgttagccctcagagtcccatttctattggtgaccaacttgcaaatggataaaacacaggaaaatcctgccccccccttcctccctgcatgtcctgtccccagagccccccaccccaccctgggccaggtcaggccctgtgggacgggagaaatagcaaccaatccaacagcggg

SEQ ID NO: 30791 - DNA, 3331 bp, Homo sapiens
gcagagcgcgcggggcgcggttgccgtggcagcgccggctccagggagggctgctggcgccgggccgggaccgcggggcctgaggcggagaccggagagcccgaggcccggccggaggcagctcgggacaggcttgagcggcggggcgcgctgcccggccggcggggatgcgggaccggctgccagacctgacggcgtgtaggaagaatgatgatggagacacagttgttgtggttgagaaagatcatttcatggatgatttcttccatcaggtggaggagattagaaacagtattgataaaataactcaatatgttgaagaagtaaagaaaaaccacagcatcattctttctgcaccaaacccggaaggaaaaataaaagaagagcttgaagatctgaacaaagaaatcaagaaaactgcgaataaaattcgagccaagttaaaggctattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaacacgctaaagaagaaacaaaaaaagctatcaaatatcagagcaaggcaagaaggaaattgatgttcattattatttgtgtaattgttttgcttgtgatccttggaattatcctagcaacaacattgtcctagcaaccatatcccaagagccatttatccttgagactcagaccacatctgcaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaacaaatgtgcatgaagtttaattaggaaggaatgctttatgttatgaaggcttttttttttttttttgagacggagtctcgctttgtcatccaggctggagtgcagtggtgcgatctcagctcactgcaacctcggcctcccgggttcaagcaattctcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggctgcaaagcccctcaaagccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaatggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgctggtggcaaaaggactccacgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtatttagatatttaagtcacttgtccaatgatgtgtatgtctaagcctcatgtaccgatttgaagtcagacttaaaaatgtatttacagattcacttgagactttttaatcggttcttcaaatatttcatgtttacattaaaaatttccagagaagcataaaagtattcactttcctgccttgtcatttctggaaagattttggggagatattttattgcatattaattaataaattgttctactaggaaaa

SEQ ID NO: 30792 - DNA, 2151 bp, Homo sapiens
gcggggcctgaggcggagaccggagagcccgaggcccggccggaggcagctcgggacaggcttgagcggcggggcgcgctgcccggccggcggggatgcgggaccggctgccagacctgacggcgtgtaggaagaatgatgatggagacacagttgttgtggttgagaaagatcatttcatggatgatttcttccatcaggtggaggagattagaaacagtattgataaaataactcaatatgttgaagaagtaaagaaaaaccacagcatcattctttctgcaccaaacccggaaggaaaaataaaagaagagcttgaagatctgaacaaagaaatcaagaaaactgcgaataaaattcgagccaagttaaaggctattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaacacgctaaagaagaaacaaaaaaagctatcaaatatcagagcaaggcaagaaggaaaaagtggataattattgctgtgtcagtggttctggttgccataatcgctctaattattggcttgtcagttggcaaatgatggtgtggataacgtcagtgtgcatgcctctctgccagggtgggaaaattgatgttcattattatttgtgtaattgttttgcttgtgatccttggaattatcctagcaacaacattgtcctagcaaccatatcccaagagccatttatccttgagactcagaccacatctgcaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaacaaatgtgcatgaagtttaattaggaaggaatgctttatgttatgaaggcttttttttttttttttgagacggagtctcgctttgtcatccaggctggagtgcagtggtgcgatctcagctcactgcaacctcggcctcccgggttcaagcaattctcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggctgcaaagcccctcaaagccctcaagtgccttctgtgagtttaaatgtgctggtgccctccagaaaagcctcggcctcagctccgtttccgcctgttccctccccc

SEQ ID NO: 30793 - DNA, 3231 bp, Homo sapiens
agggtgacagatcgctataaactggtcataagccatgactaccagcaggacacaatcagccccacccaagaagacaaagaaaaacatctgggtgccacatcccgtgatggaaacaggagttttgcccattgaaaggaggtttgccaaggccaatggggtgatggaagatgtatagaagatttctagaactgccagattagccaggaaaaagtacatgggggtgtggagggaatgattgatctgaacaatgactgcaattgtagcatttccaccgaggctggtcagatacatcatcaggaagaccacaaaaatcagcatctggacctcagggtcaggtctaatggaagaggaaaaccagaggggagtggtacacttccacttccacttcttttcaacagacctggtggtggcttcctttataattgtggccttgatgttgcaccaagaagccttgttggacacttcacctttgggcccacagtctggcaagatcccttcctccatattccaataagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtg

SEQ ID NO: 30794 - DNA, 3299 bp, Homo sapiens
agcttgtccccgcctagcaaggagtcggctaagaactggatcctagcgaggagcccggcacagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtgaaa

SEQ ID NO: 30795 - DNA, 1024 bp, Homo sapiens
ggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggatccatgattgaccgtattgagaacaacatggaccagtcagtgggctttgtggagcgggccgtggcagataccaaaaaggctgtcaagtatcagagtgaagcccggaggaaactgatttcactccagactggtgtggccacccttgtcttcagatgagaatggagtctgaatggccttcctgagagcgagtgcgacccgttcctttgtttccttgca

SEQ ID NO: 30796 - DNA, 1571 bp, Homo sapiens
ctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatattta

SEQ ID NO: 30797 - DNA, 534 bp, Homo sapiens
atgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaattgtgtctcttcttattcctcctccttccatgtgaccaggggatctaaaagtcagcttattacagcattgagcattcaacttcatcttgaaagataagcaacagtgagatgaacaacctctcatagacaggtggttggttgattttttttttcccctcttttttctggcacttggagtctagcccttgacttttttgtatgtgaactttaaattttggtttggctctgaacaatctgattgaaatagatgttgaaattttaaaaagatataaga

SEQ ID NO: 30798 - DNA, 6363 bp, Homo sapiens
agcttgtccccgcctagcaaggagtcggctaagaactggatcctagcgaggagcccggcacagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtgaaacggttctggctctgtctcgatgcagaaacacaatgatctggtgccaccatgtggtgatttttattcaggttttagaatgcagttcacacctttttaagccatgtgctggatcagatggttcaaaagtgcaatttttgaacatggtttaactcccacagaatgcagtgtaactatgtttgtgtttcagatttgaggtgttccccccaaaagaatttggttcagtccttgggagtatctggctttaggaggaaatgggggagatctgtcacgatgttatctagaaggtggaatgaccataccaaacatccttttaatctaacttgaatgtctcaccaaaaataacatttctgttggcattctgggtcctagaagccagatccatctcctttttccttctgttgctctcttccttcacaccctcttccatgtccacatgcacttatctccctgcagaatactttttgcgatgatgtttctcatgtattctttctttccttgtctggatgagcagaagaagatcatgatcatgatctgctgtattatccttgcgatcatcttagcttccaccattgggagcatatttgcctgaaaaaggtgagccatctgtggggagggtcagaccttctttcactgacttgaaacctttgtgtcttgggggcactctaggtgccttaatctgggtgggattaggtgctaataatggttagagaaaactaaagaaagggatgtttcagagacagaaaagtgagtgaagaatgaactgttagtaggtagtctgtgggaggaggggggagacagaaggtggcaatctgtcctataacctggtgtggcagaatgctttgtacaggtgaaggatagtgattcctgctaaacagtttgagccttggtatctggaagtgacaaaaagaacaagaattagttcttgcattaggtgcatcttgaactttttggaagagggccggccacacagtaaattcaaattaaatttcttccctttcaaggttaatgaaagttaacacagccttgtatgtagtcctttaccccgggtaagagggatttggtgatcccagccacgaacaccatgctatataatctatgatttttttcctccatttttctgttatctcccacagccctcacagattgatcgactggcatttctaatcctccttccacttctgtggtaccatcacttctccacgcagactcctcatcagcttctcctctttccattatgaaacttcttaagaaacagggcaccaatcaactacttattaagaattatgcaaagaataaacgtatacagaattgggcggaggacagggacagggagtacagatacatagctgattaggcagatggtttaaaggaggactgcagggtagagaagcaagcagagtgggcgcctctttaggaagtgacacagcctgcatgtgcagtatggctgtgaaggggcagatatcatagcacacctaactcaacaggatcttacttgaactgctgtgagttggtcaagtcagggcacttctgctcttcaggctcctctaggtcacacctttgaccaccctacatctgtttcctctttcaggctccagtagtagtcttaaaagtgaagtttatctaaggataagcacatgcctatcttgctcactgctgtgtccccactttttagcacagcgcctgctgcttacaggtactcaaatatctgctgacttaattacttataattaagctcttatttcagtcatggacaaatccttgggtttgactcctaaactctttaaggtaccaatgagaacgtggtttgttactgtcagaggctgtgtaaagccgcttgggaatgggctgatctgcttatgcaaaaatgctaccaacctttcaaaccccattaccacaacatgaaaatttaaagtgctttttctatgggtggtgatggtggagttctagcaacagcctcttaatctgtggagaagatggctggctccaggactgtggttcaataacgaaatacaggcccacaaaataaaataggtttatagcatgactgaactcacacatcagtagaacactctgtgaaccataacaaagaacagataaaggtgtcaagtgagaaaggtgaaatgaggttatcactcacttcacctctcacctgatttgtgttgctagctgaaactgctggccagtaacgtatgtataagaaactgttataggccgggcacggtggctcatgcctgtaatcacagcactttgggaggccaaggcaggtggatcaccagactgaccaacatagtgaaaccccctctctacaaaaaatacaaaaattagccaggcatggtggcttgcacctgtattcccagctacttgggaggctgaggcaggagaattgcttgaatgcaagaggcggaagttgcagtgagccgagatcgcgccactgcactccagcctgggcaacaagagctaaattccatctaaaaaaaaaaaaaaaacaaaaaaaaaaaactgttcttaatacttaatactgtccccaattccattcaaggttcagttgtgttcagctttaaaaccagctatgtgaatgtgagttctagtgcagattatttagtgattatgtaactaaaattgatgaaaaaatcacactatacaactgtgaggagcacacaactgctaagtttgtacttttgaaagtaaattattctttgtttgataccttattttttaagaaagtgggattaaaaatattttggtcagtgctgttttctacccaccttcaaaagccaatggtttgatatttctattaatttgtgcttcctttagttttaataggggatagaagactgcagctggttgggtctggaaaacattaatctgggcaaacggagctggagctatgaggatctgagtcctagggggccctcattcactagcagtaagaatttaagtggtgcatggcacatagcactgtactagattctgcaggggcacaaacatagagccaaacactctccctcttggagaatttcagacccagaaaaggccacgcagttctaacttttgtcatcggttccttttgctaaaaggcaaagggtatgttccttgcctattgtccaacataccccttccaagattgtgagaagatgggtagctgggcatcaataaatattgaatcaattgacct

SEQ ID NO: 30799 - DNA, 1481 bp, Homo sapiens
cccagcctcgggcaaggaagagacgcgaccatgtgcgcatgccccgaatttatcacggaggggcggggctgaggctgcgggagctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcatagaaa

SEQ ID NO: 30800 - DNA, 1498 bp, Homo sapiens
acccactgcctcgaaaggcctctgggggtggtcggcgcgcccctccccacctcgcgggggccgtgtgggcgtcgctcggtcgttggggtgccggggacgtcgtgatgagaacggcgtcccagagacggcggtgacagagccgggacacgtgacagtcacagggtcacattctgcggtccacgagtttgggaccgggctggtcacgtgacgcgatttccgttggaagatgcaacggttccggtgacggtagcaagttctcgcgtccaggcatctccgcttccgctcggggcgcaacaacttccgactccaccttcccagcctcgggcaaggaagagacgcgaccatggggatgacagctcggacgaagaggacaaggagcgggtcgcgctggtggtgcacccgggcacggcacggctggggagcccggacgaggagttcttccacaagccctctcggtcaccctccccaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcat

SEQ ID NO: 30801 - DNA, 1794 bp, Homo sapiens
gggggtggggttacgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctca

SEQ ID NO: 30802 - DNA, 1785 bp, Homo sapiens
cgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagagtgtccttttgtttcctcttctcccggccttgtccccaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctca

SEQ ID NO: 30803 - DNA, 1568 bp, Homo sapiens
tcgggtttcggcggcttcagtgctcggggaggaggcagtgacggccggtgagattggaagtggcggcggcggcaggcggcagaggggagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttct

SEQ ID NO: 30804 - DNA, 991 bp, Homo sapiens
agtctttggtcgggtttcggcggcttcagtgctcggggaggaggcagtgacggccggtgagattggaagtggcggcggcggcaggcggcagaggggagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaa

SEQ ID NO: 30805 - DNA, 1090 bp, Homo sapiens
gagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagaaaaaggattcctgcatgttgatgtgaggtacaaacgccattaaagaaatctacaactgaaccaggaatgaagaacggaacaaaattcttaaccattcggttttcaatgacagcattatgattttgtttgctctgtggttttgtttg

SEQ ID NO: 30806 - DNA, 3689 bp, Homo sapiens
aggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcggtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagctcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaatttgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgtctggagttggaccctctgagcccgctggctgccccagtagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaagaaaataaa

SEQ ID NO: 30807 - DNA, 1085 bp, Homo sapiens
ccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaa

SEQ ID NO: 30808 - DNA, 967 bp, Homo sapiens
ctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctggttctccacatacgattctacttgtcaaattgcccaagaaattgctgagaaaattcaacaacgaaatcaatatgaaagaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggacgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctgccaatgacagatgcaagcccaacacccttttggtacgcaaaacctgctctcaataaattcccccaaagctctg

SEQ ID NO: 30809 - DNA, 3759 bp, Homo sapiens
gcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccaggggg

SEQ ID NO: 30810 - DNA, 2329 bp, Homo sapiens
gcccagtccgcgcgtcagtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagagtaagcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggttctactcacattcttactcccaccaaatttctcatggacctgagacaccccgacttcagggagtcctctagggtatcttttgaggatcaggctccaacaatggagtgagagccaaagaaacaaagatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatgg

SEQ ID NO: 30811 - DNA, 1868 bp, Homo sapiens
agtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggttctactcacattcttactcccaccaaatttctcatggacctgagacaccccgacttcagggagtcctctagggtatcttttgaggatcaggctccaacaatggagtgagagccaaagaaacaaagatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacata

SEQ ID NO: 30812 - DNA, 3909 bp, Homo sapiens
agtccgcgcgtcagtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggttctactcacattcttactcccaccaaatttctcatggacctgagacaccccgacttcagggagtcctctagggtatcttttgaggatcaggctccaacaatggagtgagagccaaagaaacaaagatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccaggggg

SEQ ID NO: 30813 - DNA, 1889 bp, Homo sapiens
accttgggacacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgcc

SEQ ID NO: 30814 - DNA, 1840 bp, Homo sapiens
caaatccattcttaaaccttgcaagctgactgcgggagcccatggattgcaggcctcccctgcagcactccctggctgcagccccttcctgaccgtgcagctccctcgtggagccctgtgtgggactcccagggtggactctggatgtggggtcccaagaatgcagagccttctatgggtgaccccaggtggtgtcccagtcactttgccattgagggataggtgctgagggagcctgtcctctcagaacctcagtctccctgtctgtaaatttggggaacccagttggctgcacaacccctgcagaaccctgtcgtgtggctcttagctggtggtccctaagtgggtttctcctgcagtccctcctaagcatccacccctcctccccaagcctccaaccccccacacctgagactccccacgtggccctgcctggatgccacccacctgtgtcccttcctctgttcctactagttgttgaagacatcaacaaacggcgggaacccattcccagtctggaggccatttatttgctgagccccacggagaaggtgcctacatgagtgagcgtgtgtgtatgcgcgtgcatgcgtgtacatgtgcatgtgtgtgtatgtctgcatgcatgtgattgcatgtgtgcatgtgtatacgtgtgcatgtgtccatgtgtatgtgtatgtgtgtgcatgtgtgtgtgcatctgtgtatgcatgtgtgtgcggtttgcatgtgtgtctatgtatgtgtctgtgtgcatgtgcatgtgtgtgcgtctgtgtgtgcatttgtgtgtatgtgtgtatgcgtgtgtgtctgtgggtctgtgtgtgcatttgtgtctgtgcatgtgtgtatgcgtgtgtatgtatgtgtgtgcatctgtgtgcatctgtatgtgtgtgtgtgcgtctgtctgtgtgcatgtgtgtatgcgtgtgtatgtatgtgtctgcgtctgtgtgtgcgtctgtgtgtatctgtgtgtgcatgtgtgtatgcgtgtatatgtatgtgcatctgtgtgcatgtgtctatgtatgtgtgtgcatctgtgtgtgcgtgtgtatgcgtgtgtgtatgcgtctgtgtgtgtatgcgtgtgtgtgcgcatcagtgtctgcatgtgtgtatatgtgtgtatgtgtgcgcgcgcatctgtgtgtgtgcatgtgtgtatgtatgtgtgtgcatctctgtgtgtgcatgtgtgtatgtgtgtgtgcatctgtgtgtgtgtgcatgtgtgcatgcgtgtgtatgtgtgtgtgcgtgcgtgcatctgtgtgtgtgcgcgtgtgcccatgtgggtgcgacactagtgtgcatttgcacatatacatgtccccgtccgtccatgtttgcacatggtggcagatggggggtggctgggaggcctaggcagccaatgagcctaggtgtgcaggctcaggcccagagagtgatccaccttccccagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtacggcccgggctcatcctgggcagggggtgggggtttgtgaccaaatgtcccctgttccctcagaaacagacactgaggctgggcgcagtggctcatacctgtaatcccagcgctgtgggaggccagggcaggaggatcacttggggccaggagtttgagaccagcctgggtacagagcaagaccccgtctcttaa

SEQ ID NO: 30815 - DNA, 1880 bp, Homo sapiens
accttgggacacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgcc

SEQ ID NO: 30816 - DNA, 1914 bp, Homo sapiens
acacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaaggctcaggcccagagagtgatccaccttccccagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgcc

SEQ ID NO: 30817 - DNA, 1869 bp, Homo sapiens
gcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgcca

SEQ ID NO: 30818 - DNA, 3940 bp, Homo sapiens
gttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagatatttgaaaagactgggaaaagagagaggaaacaaataccatttttttccaaaaggtgtatgtatctcagattgcctaggaaagaagagataagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggagccttttattattttatcaggaggtttgtcatatgatactgtaggaagaagaccttgcttaacagtgatgcatgggaaaagcactgctgtgctagaaatggactattcaattgttgattttctaacgctgtgtgaaacaccatacccaaatgattttcaagaaccatatgctgtggttgttcttctagaaaaggatttagtacttatagaccttgcacaaaatggatatcctatatttgaaaatccctaccctttgagtatacatgagtcccctgttacatgttgcgaatattttgcggattgtcctgtggaccttattcctgcactttattctgttggagctagacagaaacgtcaaggttacagcaaaaaggaatggcccatcaacggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctggttcttcatcaccacacaattcagatgatgaacaaaaaatgaataattttatagaaaaggcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctgacaaccagaatccaataagtccaacttcagccagaaggaaaaaagttttccatttttattacattctttaggaaagttaacgttaaagggatgttcgtcactgaatactgttctttcctagcacagtcatgcactgttttacctcagtcatgtggctttaactgaggagtgttcacacgcactcgaaatggagtatatggtgtgtgccagttatgagttgaccatttgggaattaaacaggtcacacgtgacagatgaagaaaccaagggggctgctgaggagacctggtgcagggactaatcctggatcattcctgtattaaactttcatatgccaaaagggtttgtgccgttttatctgccatcagtgtttgacctgtttagggcagaggcaataagtcagaagtcttgaagttgaaatagttatatgtgtgtcattggactggattataaacagctgtcttggactttccctctcttaacactgactggtcatcagtatcattagtgaaaaagaaacaaattgtttgttatcatctctttagacagataagctgaatggtgggctttaaataataaaaacatacacat

SEQ ID NO: 30819 - DNA, 3456 bp, Homo sapiens
atgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggagccttttattattttatcaggaggtttgtcatatgatactgtaggaagaagaccttgcttaacagtgatgcatgggaaaagcactgctgtgctagaaatggactattcaattgttgattttctaacgctgtgtgaaacaccatacccaaatgattttcaagaaccatatgctgtggttgttcttctagaaaaggatttagtacttatagaccttgcacaaaatggatatcctatatttgaaaatccctaccctttgagtatacatgagtcccctgttacatgttgcgaatattttgcggattgtcctgtggaccttattcctgcactttattctgttggagctagacagaaacgtcaaggttacagcaaaaaggaatggcccatcaacggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctggttcttcatcaccacacaattcagatgatgaacaaaaaatgaataattttatagaaaaggtgaagaccaaaagcagaaagttttccaagatggtagccaatgatatagcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctga

SEQ ID NO: 30820 - DNA, 521 bp, Homo sapiens
gaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctggttcttcatcaccacacaattcagatgatgaacaaaaaatgaataattttatagaaaaggcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtg

SEQ ID NO: 30821 - DNA, 6409 bp, Homo sapiens
tgttcggattatcttttgcttccccccagctgcctccttaccctcacactcccactcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggagccttttattattttatcaggaggtttgtcatatgatactgtaggaagaagaccttgcttaacagtgatgcatgggaaaagcactgctgtgctagaaatggactattcaattgttgattttctaacgctgtgtgaaacaccatacccaaatgattttcaagaaccatatgctgtggttgttcttctagaaaaggatttagtacttatagaccttgcacaaaatggatatcctatatttgaaaatccctaccctttgagtatacatgagtcccctgttacatgttgcgaatattttgcggattgtcctgtggaccttattcctgcactttattctgttggagctagacagaaacgtcaaggttacagcaaaaaggaatggcccatcaacggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggaggtgtgctgattgtgacttcttgcatgtgcggcctttctagcttatattctgaatctatgaaaaaactacgttcttcttttttaaccggtctgtgtgatattagtgaagggactgttgttccagaggatcgctgcaaatctccaacctctgcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctgacaaccagaatccaataagtccaacttcagccagaaggaaaaaagttttccatttttattacattctttaggaaagttaacgttaaagggatgttcgtcactgaatactgttctttcctagcacagtcatgcactgttttacctcagtcatgtggctttaactgaggagtgttcacacgcactcgaaatggagtatatggtgtgtgccagttatgagttgaccatttgggaattaaacaggtcacacgtgacagatgaagaaaccaagggggctgctgaggagacctggtgcagggactaatcctggatcattcctgtattaaactttcatatgccaaaagggtttgtgccgttttatctgccatcagtgtttgacctgtttagggcagaggcaataagtcagaagtcttgaagttgaaatagttatatgtgtgtcattggactggattataaacagctgtcttggactttccctctcttaacactgactggtcatcagtatcattagtgaaaaagaaacaaattgtttgttatcatctctttagacagataagctgaatggtgggctttaaataataaaaacatacacatagttgacttgtgtatgagctactcttggattcttgttattatagacttgtatttagttcatattttgtcaaaagcaaaacaagaagatacatcacttttcattgaaaagaaaagtgtagagcatgactgaattgctcatcattctgggagtttccatgtagtggctatgcagtgtggaaagtgagaaaaacctccattgtggtgaggagaatacttcaatgtcccttgtccttgttctcattaattcagctaaaggtggatttgaccaaaataatgctggttaaatttgtagaaatgttgaaattggctgtgttttaaattttgcttgaatttttataaaatgtttaaccaaatgtacctttgcattctttaattaaaattgcttaaaaaaaaactttcattatttcagtaaaatgctcagctcccttttcaaaatgccctttatttgctaactgttccaatacactcaggtgatgagccaattaaatgttagtgcacatgctatcgcatggaaaattacaagcatctgttgtcaataattatataagagtttagtctgatgacctacaaaatattttgtgtagaaatatactataaatctgtacatatcctttcaaggttttaaaaaaccaaaaagaaaggaaaatatgtacactgtgataactaaattatttctgtattggaatataatacaatttgagaccagcaatggacaatgaatgattgtttcatagaatagcattacgggcaggaaagaaaccacctagtagatctagaagtaagcaatctcagaatacagactaatctgagattattattgattgttgttaaagcaacccagcaaaagcaaaatggaagcattaaaattaatgttaatgaaatttaaatattgtcttctataaaaaattcctttaaatgattttgttttttcattaagagataatcagagcacaaattgatagtaaacaggatggttgtttttctattctatatgatcattaaaggaatatgtaggacatcttaactttttcatacagtctgttatgcatattttcctctacttttcattaataaagcttttatgtttacattttataacatgcactactagatgcaaaagtttacatcaaagtttactttaaatatcatttggtagggactaaatgtgtgtgatagagataattgatcaagccaaaagaaatattttttaaataagcccttttcaaaagtttttgaatttatagaaagcaccaatgaataacatatttctgtttcgttaatgtcagctgcctgaacattcagcagtttataaattgcttaatttgtgttatctattatccagtaaacccatagttccatgatatgtcacaggaattgttaggtcctattttaaaggtacagttttgtgaatgtcatcaataaaatcaacagttatggatttgaagaagttgggaaagcattatgtagattaatatactggttggttccctatctatgtggaaggtcatattagctgcaattatttaatttgctgtgttattttgtgttatataacacaaatatatttgtatattaacttcatttttactgtcatttttcctgttgtatacaaaatgaactaatcttgtaattattttcaaatatagaagtatatacattagatggatttccaagattttgtaagaaaatcttaaatcagtgttttgagttatttaatttttaaattaatctacaaattatgcacaacaaactagagactcagttaggattagaaagcttaaagtatgtttgagtgtaggaaataagcttctcagagttatacttgattctgtctgtagataagagacagtctacagtaataactaacccagggaatttactgtaatttgagaggtaacatctctatttttttctttttaaatacagaaagtaatagtcaccagcaagccacgatttcaggaaaactgactaaaaaaaaaagtcaaaatagaaaatatcagaaaaatgaaagatttttgtgtgccctctccatatcctcattgtttttgttgcatttgtccttgactctaaaatcactgaagtattcatgattagtagtttgtaagtaggaagtggtttttctgtatgtaccatatatccagttcatttcagttttcaaactaaaatccatatgtatttgctgagaaagttatttgaaatcttatattctgacaaattctgtacatt

SEQ ID NO: 30822 - DNA, 3297 bp, Homo sapiens
atgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggagccttttattattttatcaggaggtttgtcatatgatactgtaggaagaagaccttgcttaacagtgatgcatgggaaaagcactgctgtgctagaaatggactattcaattgttgattttctaacgctgtgtgaaacaccatacccaaatgattttcaagaaccatatgctgtggttgttcttctagaaaaggatttagtacttatagaccttgcacaaaatggatatcctatatttgaaaatccctaccctttgagtatacatgagtcccctgttacatgttgcgaatattttgcggattgtcctgtggaccttattcctgcactttattctgttggagctagacagaaacgtcaaggttacagcaaaaaggaatggcccatcaacggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctgatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctga

SEQ ID NO: 30823 - DNA, 4431 bp, Homo sapiens
actcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggagccttttattattttatcaggaggtttgtcatatgatactgtaggaagaagaccttgcttaacagtgatgcatgggaaaagcactgctgtgctagaaatggactattcaattgttgattttctaacgctgtgtgaaacaccatacccaaatgattttcaagaaccatatgctgtggttgttcttctagaaaaggatttagtacttatagaccttgcacaaaatggatatcctatatttgaaaatccctaccctttgagtatacatgagtcccctgttacatgttgcgaatattttgcggattgtcctgtggaccttattcctgcactttattctgttggagctagacagaaacgtcaaggttacagcaaaaaggaatggcccatcaacggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctgcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctgacaaccagaatccaataagtccaacttcagccagaaggaaaaaagttttccatttttattacattctttaggaaagttaacgttaaagggatgttcgtcactgaatactgttctttcctagcacagtcatgcactgttttacctcagtcatgtggctttaactgaggagtgttcacacgcactcgaaatggagtatatggtgtgtgccagttatgagttgaccatttgggaattaaacaggtcacacgtgacagatgaagaaaccaagggggctgctgaggagacctggtgcagggactaatcctggatcattcctgtattaaactttcatatgccaaaagggtttgtgccgttttatctgccatcagtgtttgacctgtttagggcagaggcaataagtcagaagtcttgaagttgaaatagttatatgtgtgtcattggactggattataaacagctgtcttggactttccctctcttaacactgactggtcatcagtatcattagtgaaaaagaaacaaattgtttgttatcatctctttagacagataagctgaatggtgggctttaaataataaaaacatacacatagttgacttgtgtatgagctactcttggattcttgttattatagacttgtatttagttcatattttgtcaaaagcaaaacaagaagatacatcacttttcattgaaaagaaaagtgtagagcatgactgaattgctcatcattctgggagtttccatgtagtggctatgcagtgtggaaagtgagaaaaacctccattgtggtgaggagaatacttcaatgtcccttgtccttgttctcattaattcagctaaaggtggatttgaccaaaataatgctggttaaatttgtagaaatgttgaaattggctgtgttttaaattttgcttgaatttttataaaatgtttaaccaaatgtacctttgcattctttaattaaaattgctt

SEQ ID NO: 30824 - DNA, 791 bp, Homo sapiens
attgaattatatggctctaatgatccttatcggagagaaccccgatctcctcgtaaatctcgacagccttcaggaggtgtgctgattgtgacttcttgcatgtgcggcctttctagcttatattctgaatctatgaaaaaactacgttcttcttttttaaccggtctgtgtgatattagtgaagggactgttgttccagaggatcgctgcaaatctccaacctctgcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattac

SEQ ID NO: 30825 - DNA, 2160 bp, Homo sapiens
actcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggtttgttgagatccaacagatatattccaacaatagctatattccaacaatagattaaatgaactctaagaggtgtatcatctgtttgactcttgcatccttcattgtgtgacctgtagcatagttatctgacttctttgtggttcattttcctcacttatgacatagatggataaaatgtcagacattagttgtttaattgagatgataatgtatgtaaaacatttcaagcagtttctggtatataataaactctataaatgattgagaagccatttttttaaggaaatcccctgccaccaattgatttttatttgttacatttgtcctatggcaaaggaattaaaataggaaaagcatggtagcaaagaaagaaaaacaggaagaaaatctgaaaaaaaaaatctatgattataatacaaaatgaattggctaaatatttaaattaatagtgactaattaggttctattcttatctagttattttaacaaatattgactggcaacaaaggcagcagttcagggaagattttttcctctgtgcttcacctgttccagtttttactcctaaataatgttaatatttatgagttcaggtttcttcaagatggcagtaatacttttcctttcatagaattagaaatgaaaatttaaaatgttgctcttttgtaggcatttgtaaatacagtcatccactacctaatagcatcatgatcagtggtggactgtatatacaatgacggtcccaataaattataatattgtactttactgtaccttttctatgtttatatacacaaatacttaccattgtgttacagttgcctacaatacttagtacagtaatatgctatataggtttgtaacctaggagtaataggctatacaatatagcctagatatgtagtatatcatcgagatttgtgtaagttacactctatgatgttcatacaatgacaaaattgtccaatgatgcattcctcagaaggtatcctttgttgttaaatgacgtagttatactgttaactggatcagtaagatcaccattttgtaacagtgttctctactttctcaatttcttttgtcacctaagatgggaaattcagtaaattcaacatattcttcttttctctc

SEQ ID NO: 30826 - DNA, 9496 bp, Homo sapiens
gacgtccccgggcaccccgcccccttcacctcccagctttgccggggaagaagcagggcggggcaagctaggggccggcccgggggcggggcctgcctcccacggcgggagggcggagcctgctctggagcctgactgctcggttaggacctcggagagcgccaggcgccgcgaccagagggcccagagaagcggccggagcccgcctacctcggccccctcagcttcccgggctggcaggcggctagaggcgtctgaggaagtgtttaaaatgaagaagtttaatttccgaaaagttttggatggcttaactgcctcctcccctggcagtggtagcagcagtggcagtaacagtggtggtggggctggaagtggttccgtacatccggcggggactgcaggggttctcagagaggaaattcaggaaactttgacttcggagtatttccagatttgcaagacagttcggcatggttttcctcatcagcccacagcattagcctttgatccagttcagaaaatcttggctattgggacgagaacaggtgctatacgaatactcgggagacctggtgttgattgctattgccaacatgaaagtggtgcagctgtcctacagctccaatttttgatcaatgagggtgccttggtcagtgcaagttcagatgatacacttcatttgtggaaccttagacaaaaaaggccagccatactccattctcttaaatttaaccgggaacgaattacttactgtcatctacctttccagagtaaatggctttatgttggaacagaaagaggaaatacacatattgtaaatattgaatctttcattctttctggatatgttatcatgtggaacaaggcaattgaactatccactaagactcatccaggtccagttgtacatttaagcgatagcccaagagatgaaggcaaactgctaataggttatgaaaatggtactgtagtattctgggacttgaaatctaaaagagcagaactgagagtttattatgatgaggctattcattcaattgattggcatcatgagggcaaacagttcatgtgcagccattcagatggtagtttgactttatggaacctgaaaagcccaagtcgccctttccagaccacaattccacatggaaaaagtcaaagagaaggaagaaaatctgaatcttgtaaaccaattcttaaagtagaatacaagacctgcaaaaacagcgaaccattcataatattctctggtgggctgtcctatgacaaagcttgtagaagaccaagtttaaccatcatgcatggaaaagcaattacagtacttgaaatggatcatcctattgttgaatttctaactttatgtgaaacgccctatccaaatgaatttcaagaaccctatgctgtcgtggtacttctggagaaagatctcattgtagttgatctgacacaaagcaattttccaatctttgaaaatccatatcccatggacattcatgaatcaccagttacatgcacagcatactttgcagattgtcctccggatttgattctagtactgtattctataggagtcaagcataaaaaacaaggatacagtaataaggagtggccaatcagtggaggagcttggaaccttggagcacaaacatatccagaaattattattactggtcatgcagatggatcaataaaattttgggatgcttctgcaataactctgcagatgctgtacaagctaaaaacttcaaaagtgtttgaaaaacagaaggtaggagaaggaaaacaaacatgtgaaattgtagaggaagacccatttgccattcagatgatttactggtgtccagagagcagaatattctgtgtatcaggagtctctgcatatgtcataatttataaattcagcagacatgaaattacaacagaaatagtgtcattagaggtacgacttcagtatgatgttgaagatattattacccctgaaccagaaacaagtcctccgtttccagatctctcagcccagcttccttcttcaaggagtctttctgggagcactaacactgttgctagtgaaggagtaacaaaggacagtattccatgcctcaatgtgaagacacggccagtgcgaatgcctccaggatatcaagcagaacttgttattcaattggtgtgggtagatggtgaacctccacaacagattactagtcttgctgtaagctcagcatatggaatagttgcatttgggaactgcaatgggttggctgtggtggattttatacagaagacagtactgttaagcatggggaccattgacctatatagatcaagtgacttataccagcgacaaccacggtctcctcgaaaaaacaaacagttcattgcagacaacttttgcatgcgtggcctgtctaacttttatcctgatttaacgaaacggatccgtacttcctatcagagtttaactgaactgaatgacagtccagttcccctagaacttgagcgctgcaagtctcctacctcagaccatgtaaatggacactgcacaagtccaacttctcagagttgcagttctggaaaacgtctttctagtgccgatgtttcaaaagtaaatcgctggggtcctggaagaccaccatttcgaaaggcccagtcagcagcctgcatggagatttctttaccagttacaacagaagaaaaccgagaaaattcctataatcgttctagaagctctagtatctccagtattgacaaagattctaaagaagcaattacagcactatacttcatggactcctttgcacggaaaaatgactctaccatctctccttgtctgttcgttggaaccagtctgggaatggtgttaatcatctccttaaacctaccattagcagatgaacaaaggtttacagagccagtcatggtattgccaagtggtacattcctctcattgaaaggagctgtgctaacattctcctgtatggaccgaatgggtggattaatgcaaccgccatatgaagtttggagggatccaaacaacatagatgaaaatgaaaaatcttggagaaggaaagtggtaatgaactcatcttctgcatcccaagaaataggagatcatcagtatacaataatctgctcagaaaaacaagccaaagtcttctcactgccttctcagacttgcctttatgttcataacatcacggagacatcttttatactgcaagcaaatgtggtggtcatgtgtagcagtgcctgcttggcatgcttttgtgctaacggacatatcatgataatgagcctacctagtcttcgcccaatgttggatgttaattatttgccactgacagacatgaggatagcacgaacattttgttttaccaatgaaggacaggcattatacctcgtctctcctactgaaattcagcggttaacatacagccaagaaatgtgtgataatctacaggacatgctaggagatttgtttactcccatagagacaccagaagctcaaaacagaggctttctcaagggactgtttggtggaagcggacaaacatttgacagagaagagctctttggggaagcttcggcaggaaaagcatcccgcagccttgcgcaacacattcctggaccaggtagtatagaagggatgaaaggcgctgctggaggggtgatgggagagctgacccgtgcacggattgcacttgatgaaagaggacagaggctaggagagctggaagagaaaactgcaggcatgatgaccagtgcagaagcattttccaaacatgcacatgagttaatgctgaaatacaaggataagaaatggtaccaattctgacttctaaagaagctgtgactgctttgagaaaccatattcagggaaaccaaatttattcccagcatcactactcaactgctagaagccagtttcttctacaaaatgttccatttacagtcaatctgaaattttcataaaagagatgtatcagagacactgtgcaacccaaaggctggagccctggttaaaatcccaaaatacggctgaatttgccttttcccatgtggaatggagctatcatcttggcatgtcattcgataaggatttatatttagtaactacggggagtcctcttgatttgaaaattcctgtacaaacaaaagcattaatgcacttaatgaaaaaaaatctttgcatgataaattaacatcttaaggggaaaagaaaaaaaagcatgttgtgatagaagaaaaaaagattcatggtaaactatttctatcaattgggccacactcaacaatttaaaaaatctgcatttgaagatgtcagtgcatttcaaatatatttgccatacccaactgaaacggaaaacaaaacaaaacaagaacccagagttttctcctcatctgtaactttcattgtactagaaccttattgaattcttatggcaagagtctgattaatgttctctctccatgttttacatcattcacagttgtgtcaaaatcaaatattgccagtatagtaaattattcccaacacaatcagtttcatttctatcaccttcagaatgggttgctgtttttagcacaaaccatgcagggttgggtcacctcaaagcattttcttcagcctggcttgtactctataggggagttggtagtaggtgtggggaatctataggaacaatagagttagctatgagaactgacttcacaaaaagggaaatttcacacaccccaatttcagcttctaaagtgatatattttaaaagcttcatttgtatccttgtctgccagttacacagtatattactgttcaaacccagtagggtctgcaatcgaaaggtgctcttgcagcctgacattcacaaaccaaactggtcattctctttagtgtgattcagtaaaatctcagttaatgttttgggaaagggattctgatttatgacatttctgatttacaagggctttccttagaaaatacctttcggtttgatacttaccactggaaattggttcgatacttaccactggaaatctttataaaatatagtgatctgtttgctatcttggtctcagtcatcattatagacaatagaaatacataaagagtttaatgatacaaaatcaatgcttttgtccctaggtcaaataatataagccactagattatgtcaatagatgccaaacacttgtcccttattaaagactcttttaaagctggaataaagaatatccttaacatgatacaaggtatctataactcaccagaaaagcaccagagtcaaaaccaaatagagacacctactaccatttaacatgattctggaagtcaaaagttataggaatgtatatatacacattccaggacccatcctgtaatatgttgtttcgtcaagaaaagttttaattatggttttggcttattgaatttttgtttatcaaggtctcattggatttacatttgtgtttcttaagacttcacaattttcctggatttcaggttattttattagccaaaaaatcgtatttttatttcctttttagtctaattttttgctagaagttgtactttctagcaaatgtttctagtggtacaatgttctcagtaattttgaggagaacaaagatgagtgaaagagttagataatgtacactaggatagcatttctcagagtccttgaatcctcttgttaagaaagcctctctgaatctcccagactcctgtgaacagccttacggtaacagaatctggcttggaaacacagacattacatgactgtataatttatagaattataaaattatatggtaaaaatattaaagaaacttaagagtaggatctagaaaatactagtggccaaattgcaatgtattctttgtaccatctgtttcaaagacttagttttctgattttcagaacaaatactttatcgtttctgtattttaaaaaaaactaaaagagtaaaatattagtttattttagaaataatgaaattcagtccaaagtagcagtacatttgatgagtatttctgaagccttcaataagatttaacttgttttaacttgatctacatcgagatttctcaaaagcagcactattagctgaaagtctttgttgtggggaactgtcctgtgtattgtaggatgttagcaacatccctggcctctgtctactagatgccagtaagaacctcctagtaatgacaatcaaaatgtctccagtcattgccaaaatttctcccagttcacagccactattctacatcatacaaagaggtagattgtgtgaatatgtaatatatgttgttgtataaaactgtacaataagtatacaatgtcttagcaagataaattattatacccaaaattacatgtgtggttcatatgcaataagatacaattttgaagaaagcttataggaatcagtgaaaaataacaactacagaatattttaaggcacacagagaaaatatcaaaaaggacattatagcatttcactgtagaagtgcttaaaaccttggcctcagtgaatagatcaaaagtttataattagcacaccaattggaagtaaacaggtgcttctcaaatgcttgaaaagaaaaggctctttgaagtagttaaaacgtgtctttcaaaattgcttttataagcccttccttaacgtaagggtaacttcatctcacaaactcctggttagtggaatccaaattaatgaggttttactgtatcaaaattatttttataattcaaagagatgatagcaataagaagaatctaatgtggatgtgatttttctctttgaacaattctgttctgttgcactgaccttagcacgcacgcacacacacacacaccatcgccaccactaccatcatcatcttatcctcatctttggaaaataagtactgttgatccatgtaatcctttgcatagtctcatctttactatctttcttctatttcggaacataagaaaaatactcctaataacttggacaatgatacagaaagtgactctgagccttagttaccatcaaaattacattctatctgctaaagcgacatcagaagataaggcttgcaaaccacagtcccaacaagttgaccttgtctccctatgatttccttggaagataaggcctttttagtgttacagtagaaaatgggccttttcatttattcatctgtgagaagctagaggtatttgtttccctgataataacgtgagcaatagtccctaccttgaaatcatccattagtcttggagtttggagggaggaatgattgattcctcatttgttttaatcacctacaaaagcagtactactgactttgcttcttacacttcactgagccccagactttagggccccaatcattgtcaagatcattgtctaactggaactctgaaaggacagtgacagaactgaatgagatgttttccagtgattcagtcacaaagacaattttctcagatcttttgaaagtgattctcaaataaataaatcaaaatccaactcctttccctcaaagtttctagggatctgaaggaaaaggtttactgttggagtccctttttatgtgacccatgtaccagttttaaaggcatcatctatactttatctacatgaagggatcaccatgactttgagagaaaaaagaatcagattaggcctaacattggttgaagaagattaaaatagattcttatattcaagcagaagggaaaaatgaagccaatctagaaaagtaagctaaaaatcctctccttggcttaggatcattgggtcaaactgggagtatatctgtgtgattacaacctgctgctatgagaaaaaagaattgtaacttgaccatgttggctcacacagggcaatgcaaaagaagtcaaaacattcatatcaggtcttggtatctgtgtcaggagaaacgtggtggctttcacagcttcttcacctctgtcctctgtcatgcaactccatttttggctaggtactatttcacatgcacactgtcctgggtgccagaaatacttgtggtgtacttggtttgagcagtacctctagtatgcaccattccagggaacatggttgtcaacataacaagtttagtgtgtgtatttgcagacaacatagccctgaaagcatgaaatgtagaataggtaaggtctgtcttagaaaaggaggaggaagtaccaatttggtgcaagaagatcgtggtgaggaaggacatgggagccacagtgaagtgaaagaggctttaaggaatcagatgcacagatggatgctttgatttacacatttatctagaggagtgattctcaaccttgactgtacataagaatcacctcaggaaatttttaaattcccaattatattaaaatcatttggagtgggaaccagacaccaatatttgcgaaagcctccaaggcggttctaatgtccagccaaagttgattatcactgctttatggccaactaaggaaaccttgtttgtctgccttggctggtgctccagccccagttctgagtggtcagggaaggcaagatgtaagatatagtaatggtatttattctgtatgtctcacagaacaaaagcatttgagaatttctgaccaggcagtgctccatcaactcttaataatcatctttgtgatattctcctatgtgacttgtccatcaattattccaattcaaaggtctaggttttttttcaattgtcttacacatgtgacatcacaagataccagaagtagcacagtaaattcaagagcatataaagctaagtggaaaactaattcttcatatttagacagtggaaattctcaaaacaatcatttgctaaattaggtccaaatttattattcattcttcttctggaggagacatgggtaccaggtacctgttctgctgtaggtatatttcactggacttggtcttagcaaaaaggaagaacaaatcttcctttttgattgttatctcaatcaaaagctcccagggccacttggatttattttcttagtctttggacatgtgtttaaaggaaaagaatacctgtaacttcctatatgacatccagtgccctgaaagggtgcttacaccttcaaaaaaggagagtccagcctatcaaaggcagtaacacataatgagaagaaactcagagttattgcctttcatactgctttccctctgctgttggcccacccttcttgactgcaaagccagaaaataaactagatggtggttttggacaattgtacacaggaacagaatctctaataacctataatttttagtacttaattatgtgatgttttattctaggaaataagaaacagatgacatcattgatgtatctttctttcatcttcagaatttttgcatcttttcagaaaatgacaaattactatttttctgttgcactcagcaattgtgactatacttaacaaaattcttgtagtctgtagagatatcaataaaattgtatatgtttgtacata

SEQ ID NO: 30827 - DNA, 479 bp, Homo sapiens
cccccaacgtcgtttttctgaaaataaaatactctgagccgaacgtttcgaagaaggaaagtccgcccttaagagagagacagagtcttgtgtttaaaatgaagaagtttaatttccgaaaagttttggatggcttaactgcctcctcccctggcagtggtagcagcagtggcagtaacagtggtggtggggctggaagtggttccgtacatccggcggggactgcaggggttctcagagaggaaattcaggaaactttgacttcggagtatttccagatttgcaagacagttcggcatggttttcctcatcagcccacagcattagcctttgatccagttcagaaaatcttggctattgggacgagaacaggtgctatacgaatactcgggagacctggtgttgattgctattgccaacatgaaagtggtgcagctgtcctacagctccaatttttgatcaatgagggtgccttggtc

SEQ ID NO: 30828 - DNA, 4132 bp, Homo sapiens
gaggcctggggcgggtcgcgggtcccggcccccagcccccagcccctagccgctgctctttgccccgggccagggcgctcgggctcgcccacggcggcactgagcatgctcagaggcggccgcgcgggcaggtttgcttcgcaggcgctcgcactcggcggcgggcgggcgcgcggctgcagctggagctccagcgcccggagttggagttgccgggagtttccccccaacccctcccttttcgcgcgcggcagcaggagccggcgcgggagccgcgagcggcggcgagccagcacccgggccggctaagccttgtccggagcccggagccccgcgcggggcagccccccggggaggagcctcgtgctctgggacgcgtgccgcgcactggcacggcaggggcgcgagccaggctgcacgattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaaaaatcagaatcgcagatagaaatctctttcctgagttacagtttaaatactcttgctacttgtatccagggtgtttacttggaattatcatatgaagggtaaaaatttgagagtaaagccctaaagaaaagcctacctaaaaccctctgtgtactcacagatgtttctcttgtcactgtcatagtgatggtcgctggtatggaaaagtgcttatatttttatcaaaaaattgatttgtccaggtaaaggtctgtgtcaatgataatgtgaacaagtagtacatttaaaatgtttgtcttgtctttttacagtcatgcctattttagagacaccttcataatgtccttgggagagggcctttagtttcttggtatctggattttggaggttttgatgttgtttttgctatctatttatttaatgtaatttaatatgtgagtttcttgacaaattgcatttcatggcaattgcaccttgcctggtctgatataaaacaccacaatcacaaacctttacattgcagtcagtttcaatacagttggtcacacacctcgtgattttctattactcaagataataaggggcttagggtctagaagttctgtttcctagagggttaaaatgctaaacataaaaaaagctgtgctttttttgtgaaactaggagacaagctgcacatctcagacacattgtaagcctaccactgcagcgcattgatttttaagctgcctgaatcttcaggacccctatctattccatcctatccattttgctgattgagtcgatatgtattgcagcctcttacataggagcataagatgacttttggattgttaatactgatttaaatagctgaagttctcctaataaagcattcccaaggagagagaaagtttgtctactgggggtaaaaatatcagatggtgcacattaaaagggagatgagatttgtcggagacagatttcagaatccttttagatgatccaattcaagaaaaccctctataaaatttaataaactgtataagttaactataatattttatactttctttttggtgtcttaaaaatttaaagaagcgaggaacatgccatttggtgagtaccgttggaagctattttaatttctaggaaaagccccaaatatcactccaaatagattttgtttgcagatctcagttcagaatgcacacacacacacacacacacacacacacacacacagagatgtatttatctttccaaattggattctggtttcagagatagagagttggtataaataattgaaaggataaatctaaaaccccctgacagtccgccaaattcaagaacagaagtggttgccaactctctaacaacaatgtttgggaagctgattccaaagtagctgaggatgaggtcataagcatactgtgaaacccaagattcttcttccctggtagaattacaatagttactcttgataaatataagtattccatgtcttgccctctttcctcactctctgcttatccttttagacctaagtttcattggaaatagcctgaattagaagaaagcccatccgaatctttattagccccctctaatgattagtttccaggctgcgttcatacctttgacctctcagtgtcaaagtcctacctaggcctccccacaacagagagggccgtaacagcaatccctgcccctcctttacctcccagcctcttgcagaggagcccagtgataacacatgtgaagttctttgctgtcctcttgtagaaggtgctgcagtgcaaagtattaatacggtcttagacaaaataactgtcatgatttgggaccagtttggttgagcttgtcagaagacatttcatttgtttcatttctgcacttctctatgaattttgggatactatatttctgtgaaggacttattgtatagacaactcaaaaaggaaagaaactttccagtattaccacttcttcctggaatatagctgtagtatttctcactagtattattagatacctgtgtacagaaagtatgcagttattcaggttaatgtttcatattaaagaatgtatttgtaaaatgtaacatgatcagtagttaccttttttcaagctctgaagaagttcagattacgtgttagacttaagttacagtgaaaactgttttaatactacttttgtggctagcaaaggttgtgcatctatttaaaattatttacaggatgctctaaataaggggcattaaagataggtttagctcttaattttagaaattgtgacactactgatgtctgtcatacagttattcttcagaagttctctgagatgtcaaatataatttttgtttaattcagagataagtaacacctgctctattgattcactattacaacaaaccctaattttgtcattaaatattttaactctg

SEQ ID NO: 30829 - DNA, 686 bp, Homo sapiens
gggcgcgagccaggctgcacgattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaaggtgacctttcggggaagaaaataa

SEQ ID NO: 30830 - DNA, 4021 bp, Homo sapiens
ctcccttttcgcgcgcggcagcaggagccggcgcgggagccgcgagcggcggcgagccagcacccgggccggctaagccttgtccggagcccggagccccgcgcggggcagccccccggggaggagcctcgtgctctgggacgcgtgccgcgcactggcacggcaggggcgcgagccaggctgcacgtttcctgtttagaaagttctgctccttcataaggaccttgaagtactaggaggaaaggtgctttgtgtgtggagttttccatgaagtgcagtcccaactaaaaggctgcgttaaagattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaaaaatcagaatcgcagatagaaatctctttcctgagttacagtttaaatactcttgctacttgtatccagggtgtttacttggaattatcatatgaagggtaaaaatttgagagtaaagccctaaagaaaagcctacctaaaaccctctgtgtactcacagatgtttctcttgtcactgtcatagtgatggtcgctggtatggaaaagtgcttatatttttatcaaaaaattgatttgtccaggtaaaggtctgtgtcaatgataatgtgaacaagtagtacatttaaaatgtttgtcttgtctttttacagtcatgcctattttagagacaccttcataatgtccttgggagagggcctttagtttcttggtatctggattttggaggttttgatgttgtttttgctatctatttatttaatgtaatttaatatgtgagtttcttgacaaattgcatttcatggcaattgcaccttgcctggtctgatataaaacaccacaatcacaaacctttacattgcagtcagtttcaatacagttggtcacacacctcgtgattttctattactcaagataataaggggcttagggtctagaagttctgtttcctagagggttaaaatgctaaacataaaaaaagctgtgctttttttgtgaaactaggagacaagctgcacatctcagacacattgtaagcctaccactgcagcgcattgatttttaagctgcctgaatcttcaggacccctatctattccatcctatccattttgctgattgagtcgatatgtattgcagcctcttacataggagcataagatgacttttggattgttaatactgatttaaatagctgaagttctcctaataaagcattcccaaggagagagaaagtttgtctactgggggtaaaaatatcagatggtgcacattaaaagggagatgagatttgtcggagacagatttcagaatccttttagatgatccaattcaagaaaaccctctataaaatttaataaactgtataagttaactataatattttatactttctttttggtgtcttaaaaatttaaagaagcgaggaacatgccatttggtgagtaccgttggaagctattttaatttctaggaaaagccccaaatatcactccaaatagattttgtttgcagatctcagttcagaatgcacacacacacacacacacacacacacacacacacagagatgtatttatctttccaaattggattctggtttcagagatagagagttggtataaataattgaaaggataaatctaaaaccccctgacagtccgccaaattcaagaacagaagtggttgccaactctctaacaacaatgtttgggaagctgattccaaagtagctgaggatgaggtcataagcatactgtgaaacccaagattcttcttccctggtagaattacaatagttactcttgataaatataagtattccatgtcttgccctctttcctcactctctgcttatccttttagacctaagtttcattggaaatagcctgaattagaagaaagcccatccgaatctttattagccccctctaatgattagtttccaggctgcgttcatacctttgacctctcagtgtcaaagtcctacctaggcctccccacaacagagagggccgtaacagcaatccctgcccctcctttacctcccagcctcttgcagaggagcccagtgataacacatgtgaagttctttgctgtcctcttgtagaaggtgctgcagtgcaaagtattaatacggtcttagacaaaataactgtcatgatttgggaccagtttggttgagcttgtcagaagacatttcatttgtttcatttctgcacttctctatgaattttgggatactatatttctgtgaaggacttattgtatagacaactcaaaaaggaaagaaactttccagtattaccacttcttcctggaatatagctgtagtatttctcactagtattattagatacctgtgtacagaaagtatgcagttattcaggttaatgtttcatattaaagaatgtatttgtaaaatgtaacatgatcagtagttaccttttttcaagctctgaagaagttcagattacgtgttagacttaagttacagtgaaaactgttttaatactacttttgtggctagcaaaggttgtgcatctatttaaaattatttacaggatgctctaaataaggggcattaaagataggtttagctcttaattttagaaattgtgacactactgatgtctgtcatacagttattcttcagaagttctctgagatgtcaaatataatttttgtttaattcagagataagtaacacctgctctattgattcactattacaacaaaccctaattttgtcattaaatattttaactctgtgatga

SEQ ID NO: 30831 - DNA, 1970 bp, Homo sapiens
ccaggctgcacggtaggaccggggcgaggggagccaggcggtcagggcggaggccaagcccgggagatgcggttgcagccgccacggctgttggggcgcctggcgctccgtccgaggcgggtggctgtgaggccaggggagtaggcaggctcccagagagattcttccaagttggcgggtggcgggagagggggccgcgcgccccggcgcagctgctttgtgcgcgcagagagggactcgtgtccctggttctctccaaccctgggacccgttgtgcgggcagtattgggcaagccgcagaacggagcgatttcctccgagaaagttgaggatggagcctttttttccgcaccgtccccgcgatggcatgggccccgagaatgctgccccgaggctcccagtgtgggggagctcggggtcgctgcgcctctagcttgagcgcagaaatccgcgaatcactccgatcttcgcgaactctggcatcttctaggaaaatcattactgccaaaactgaggcgagcttttctggcgggcacggcaccctgcccccagggcgctggccctgggcgatgccccctttccgatctcaggcttggtcaagggcgccaggttccgaattcgcgcttgccgtgcacgccggcatcgagcctcaccaacaccgccgggcaacgtggctggagtagattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaaaaa

SEQ ID NO: 30832 - DNA, 1223 bp, Homo sapiens
attacgcttccctagggactgggtgggagagaataggatcgattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattg

SEQ ID NO: 30833 - DNA, 682 bp, Homo sapiens
acagatagaatactggcagaatggaaatgactggcatgtcagtgatgagtttatagagaagcatttaggattttcctaggtcctgcagtcagtgggtgttcttgctgcaagtgcgtcagtcaaacccaatcaaaagaaatgtcggcttgtttcctagacactagacgagcggcctttctgcagtgtgacctgccttcctcttacaggatactcaccctgccggagtctggtcactgtgggtcagctgagccagtttctgatgctcctgctctcctcctttcaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatca

SEQ ID NO: 30834 - DNA, 4021 bp, Homo sapiens; identical to SEQ ID NO: 30830

SEQ ID NO: 30835 - DNA, 1311 bp, Homo sapiens
tttcctgtttagaaagttctgctccttcataaggaccttgaagtactaggaggaaaggtgctttgtgtgtggagttttccatgaagtgcagtcccaactaaaaggctgcgttaaaggctagagtagtgcagtggcgtgatctcagctcactccagcctctgcctcccgggctcaagtgacccacctgcctcagcctcccaagtagctgggacaacagatgtgagccaccacacccagattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatg

SEQ ID NO: 30836 - DNA, 5164 bp, Homo sapiens
gtgttgtgtttggagagagggtagacagcagtgggaaggggacgtaactgagaagcatgaaacaccttgagtggaccatgagacctgcttagagttaggggaaagcttgagaggttcaaggatagaagaactcagggtggttcaggtgtgacatgggttatgtgggcatttctggattgctctgggaaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacttttccccccttttccaatcacatggcattttaagaatgccggaaagatggcggtagcggcggcggcggcggcggctgggccggctggcgcgggaggcggccgggcgcagcggagcgggctgctggaagttttggtgcgggatcgctggcacaaagttctggtgaacttgagcgaggacgccctggttctgagcagcgaggagggcgctgcggcgtacaacggcatcgggaccgccaccaatggctcgttctgcaggggcgccggggctgggcacccgggcgcgggcggcgcgcagcccccggactcgcccgccggggtccgcaccgctttcaccgacctgcccgagcaggtgcccgagtccatctcgaaccagaagcgtggcgtgaaggtgctgaagcaggagctgggcgggctggggatcagcatcaaggggggcaaggagaacaagatgcccatcctcatcagcaagatcttcaaggggctggcggcggaccagacccaagccctgtacgtgggcgacgccatcctgtccgtgaacggagccgacctgcgggacgccacccacgacgaggcggtgcaggcgttgaagcgcgcgggcaaggaagtgctgctggaagtgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccaggctggtccattcaggtccaggaaagggatcaccccaggctggtgtggatctgtcctttgcaacgcgaactggtaccaggcaagggattgaaacacatctcttcagagcagagaccagcagggacctctcccactggacaaggagcatagtacagggttgccacaattctgctgaactcattgctgaaatcagcactgcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctgtatttagattttggaggcaaagatggagagattcaactggaccttcattcctgccccaagccaattgttttcatcattcattccttcctgtcagctaagattacaagactgggcttggtggcctgaagacaggggtgacttgcctttgagaaaagaagggctgcaatgccaccagagaacgtgatgtcagacaccatctgtagtgagcagcgcaccagatgtagcgtgctacagtcagctttagctctcaagagtcgtatgtaactgtcccagactcctctgtcagtttcagcaactacaagggataccctgcgaaagtaccatgagaaatatcagagtaaaactttctagaacagtacaaggttaaagaggtgaggtgacgggaaatacacagcatagctttgaaataatgacaaccaaggacatgaccattagaacagcatgtgcagatcttaatcatcccagttcctaggcaacttgttcaccaggtacgcaagggccgaatagttgagaaatggacattcttacctactcctcctagccccctatccccagtaacagtgatcccttttcttattgtgatttatttcctaattcttgctgagttgactttcccttgtaggaaaagaaaaatatttcaaatagaaacccaccttttatttaagtatgaagcagctgttactttttaaaaaatgaattatctttcaatggtgtagaatgattccaaagtgtctccattagcatatactgagcaggaattaaataaagcatcagatactgatctgagctgtaagctggtagaatctgagccaaagtagactgcttaaattgataagctttgctaaagagttgtatgcacaaaggatgattaattctgggactatactcacaccaaggtctgctgtcttatagccaagaattacagctttatttatagagagtgaattatgggtattttttcagaaaatattgtcatctgatatacacataaaacaactcacattgttggagttaactaattatccccatttcatggttttcagtggcaacttactgacccttgtttttgcctgtgcttgtatgcatgcattttcaagcaagtaataaagcagcctcatttaattctggataatgctgggttttacatatagactgaatgctataatcaaatctattgacagtatctgcagttctttcagaattccagggaaataatataacgacctgatatctttctacaggaatattttcagacattatatagcacattactgatttaatgcttttacttttatctttcaaaacaaattcactaaaaataacacctattgattttgaagtcacttttctcaaaccttgaaaatgagctctaggatctctataaacatttctaacacttttcctgtagtttacatagacagacatctgttgttagacctgtgtgtttttaaagaatcatatgttaacaaatacccatgcaaagagcttcaaaaagtgaaaccgtgttaaaggaacacaatttttctcactcagacatatttgtttattgaattgcaaagttttattttaaatcagcatttccccaaagaatatatcatatgacgctagttccaaggggcttgactgagtggtgttttgctggggggagacaggggtttgttaatacactttactaaatactgagctgaaaaatgttaaatagatttcacgattgcctccttgaagattttaaagttcattgtggttcttcaaggcgaaatccggtgaaccattcctcacacttacctacaggactcttttctaatggagcatcttgtgaagctagtgggtttttttgttgttgttatttgttttttttttttaatgctttagaaaacacagctttaggatattgactttttgtttatttctattttcaaatgctgaaaagtcaagtcccagtttgaataccatagaaaagctttgatgcatttgtaaattatattgcactctttcactatatattttcaaaatcactggaatgttgttatacaagagaattataattgtgtattgtaaataacatattaaaatacatatattaatgccaatagttaaattcaacaatatgtaatctaaggtgctcggttctacatgaagtatgagttaactgctcataattaagttgccaagattctattatatatttatagacaaattaaaatgatcataattacaaatatgatttctttatcacttaagctttgggctgattaatatctgtgtgggggtcaatggaaactacattctctacatttataaacatttaatttaattatttatattttaggaaaatatatttgaataaaattaatgcattttctagagtaaattaaaatgttattagcaagaaatagaaaatttgactaagataattgtgtatatgaatcatttttcccccaagttaaaatgtatcataatagagaggctctaatgaatcaatttccaatactcatttctttcttattttgaattcaagttacaatgactttacactgtagattttaatcttgtctgatgtgtgctggtgtgtatgacacaaactcataagtctggatcatgcttgggtacagtcaatgaatcaaccgagtcactttgaggaatttgtttttgtccaatttgctctgtgctcaatcccatgaattattaaatttacaatgtttgtccccaaatgaaaaccaatataaatgaatgatgttttaatctgtactttatgggaagttgcctatttgtcagtagatgtggttaagtgagtcctctggtgcagtgacatccttttaagccatctcatagggatttaaagaaggccaataggaatatagatattggtttttctttctctgacttgaactaagtaggagaaaccaaaccataaacctattacaaactacccaggcagaggcatttacttaattcatcaactagtgcaattaaaaccctgaaaacacatgatccttgttgactctgcttggttgaagcaggaaagaatggtcttgatggtcagaaagttttaaaattaatgggcagggcctttctggaccctgttttccaaacacgttagatattccgtcttgaggggattggagtaggctacagtgagggggtaatttttggatgtatctggacttttaaaaaatgtgcctatatttatagcaccatgaatattatgtaaaatttatatatgaattaaataaatattcacctctgatttccagtgca

SEQ ID NO: 30837 - DNA, 2273 bp, Homo sapiens
cttgctttggggttttgcaactggctgctggcttttttcccctcccctgtctcggtctctccttcttcttttaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacttttccccccttttccaatcacatggcattttaagaatgccggaaagatggcggtagcggcggcggcggcggcggctgggccggctggcgcgggaggcggccgggcgcagcggagcgggctgctggaagttttggtgcgggatcgctggcacaaagttctggtgaacttgagcgaggacgccctggttctgagcagcgaggagggcgctgcggcgtacaacggcatcgggaccgccaccaatggctcgttctgcaggggcgccggggctgggcacccgggcgcgggcggcgcgcagcccccggactcgcccgccggggtccgcaccgctttcaccgacctgcccgagcaggtgcccgagtccatctcgaaccagaagcgtggcgtgaaggtgctgaagcaggagctgggcgggctggggatcagcatcaaggggggcaaggagaacaagatgcccatcctcatcagcaagatcttcaaggggctggcggcggaccagacccaagccctgtacgtgggcgacgccatcctgtccgtgaacggagccgacctgcgggacgccacccacgacgaggcggtgcaggcgttgaagcgcgcgggcaaggaagtgctgctggaagtgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccaggctggtccattcaggtccaggaaagggatcaccccaggctggtgtggatctgtcctttgcaacgcgaactggtaccaggcaagggattgaaacacatctcttcagagcagagaccagcagggacctctcccactggacaaggagcatagtacagggttgccacaattctgctgaactcattgctgaaatcagcactgcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctgtatttagattttggaggcaaagatggagagattcaactggaccttcattcctgccccaagccaattgttttcatcattcattccttcctgtcagctaagattacaagactgggcttggtggcctgaagacaggggtgacttgcctttgagaaaagaagggctgcaatgccaccagagaacgtgatgtcagacaccatctgtagtgagcagcgcaccagatgtagcgtgctacagtcagctttagctctcaagagtcgtatgtaactgtcccagactcctctgtcagtttcagcaactacaagggataccctgcgaaagtaccatgagaaatatcagagtaaaactttctagaacagtacaaggttaaagaggtgaggtgacgggaaatacacagcatagctttgaaataatgacaaccaaggacatgaccattagaacagcatgtgcagatcttaatcatcccagttcctaggcaacttgtt

SEQ ID NO: 30838 - DNA, 559 bp, Homo sapiens
aacatttgtccctggggtctgaggcaggcatgacctgttgaaaaccccaggccagcagagacacctgtccagggctcgatagaaaacatttcttgcatttaaggacaggaggtttaagccactcgggctacgttgactcttcattctagaatcttgggacagcgtattcccttttaactcctggggagcccagggccttggtctgagtttagcttcctccagggaacccgggtggaaaggagagacaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacttttccccccttttccaatcacatggcattttaagaatgccggaaagatggcggtagcggcggcggcggcggcggctgggccggctggcgcgggaggcggccgggcgcagcggagcgggctgctggaagttt

SEQ ID NO: 30839 - DNA, 9789 bp, Homo sapiens
gggcgggaagagggaagcgccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacagattgatagagctacattctcctgatagcaggaacacgttgatcctacgctgcaaagatacagccacagcacactcctggttcgtagctatccacaccaacataatggctctcctcccacaggtgttggctgaactcaacgccatgcttggggcaaccagtacagcaggaggcagtaaagaggtgaagcatattgcctggctggcagaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttattgcttaccaaatgtgcctttggttagggttagtggagctttattagtcactatttgaataactggaaatcactgccatttccaggagatcacctatcctagttttgaggaatagtcattgaggtgggtttccttaatggcatctcttctagtaggcagatctgtttgaacaagataaatcctaaagagccagcctgcttgaggagtagacttggtgggtgaagccagcaattccgcacaaacgtcatgttgaattgttttgggctgcccaaaaacaacaggatgcagcatcctggctgtggcctggccctttgtggcagcagtggcatggacaagcaactgctaattcgagacttactattggcttcacagcacaccctacagtgagcagggtgatgagaccgtggaacagctacctgcttttggttaagattgccagatatcattaggacacagtagcagcaagaatgctgattttgtagtgttagaaaatgaactcagcttgtttttcctaattttgaaggtggtatatatctgcaaacatttaaaatggtataatatcatataaaatgtcaaaattagcacagtccctggatctcaaagaataggtaatattgacttggatgttctttatgctctctgaagaaaggtctagggaaagttcttgtttgcttgattgatcaagagtgccacggaagaatgtgagcgctgtggagggtggaggagggtgtcacttcagatggggcaggcacagggggagaaaagaagagaaaaacacacctgtgtgcaaaatgagctatttggtttcagtgcggcctgaccgatggggaggacccatgagcagagagagttctaggtcaacattgtaactccattgtcctccttcacccataagtcagtcctccttcctcattacagtgaaaccaacaatatgcagaggttggggagagatgcctgttcttcccccagcttcatataattgtcaaagttccaaaaatgaattatctgaactgcttaaaactggaaattaaaatctagacaagaatatgtctttcaagagctttttatgttttgaaagttcataaacctaagattggctccatctgagataaattttcttttctttttttttttgagacggagtctcgttctgtctcccaggctggagtgcagtggcatgatctcggctcactgcaacctccacctcctaggttcaagtgattctcctgagtagctggggttatagctacccaccaccacacccagctaatttttgtatttttagtagaggcaggttttcaccatgttggctaggctggtcttgaactcccgacctcaagtgatccacctgccttggcctcccaaagtgctgggattataggtgtgagcccccgtgcctggcccacaataaattttcatttcagagaaggaaaaaaatctcttgaacgtccagaaatgatttctggaatcagaatttcaatatgtaataccctcaggtaggcaatcttgaaccctctatgcagtgagagcattattaatatgagatgttgaatgatgcctttacagacttcagcagcaaagccatttggttgaggttttctgtgttaatgtgaaaagctaagccactgagatttgcaggggagcttctgagccaccctgcttgttggttatatgaggatgtaaaataggtggaattaaaatgtgagcaggaaaggcaaggcatgtgtgcattttcactcattttggtcaaggttaaactgacatgtatagcactgaggtctgtagggttcttaatatcttttgagtcttgctgtgaaatgaaagtgtgggaggtttcctttgtccattagcagccccaagaaccagaacccttttgctgcttttcttacatacctaacagctctccagtcatgatgaccaaggttgttcttcaatcaaatgtgtttgtgggattttcagtccgcaaatgaagtgctctctaatgaatgggacaccatgataaatatgtatttatatttagatgccaaagtatggcaaattatttccaaatgataactacaaatgggaattttcgatattctaccttttttatagaaccagctcacttttcatttctttttcattttgaattaagaaaattgttgaggatgtggtgggttccagtgtgtggaatggaaaggaaactgcagaatagtgtctgctccccattcagagggactgcttcctgtgccccccagacccggggcttcgacagcttctccacattccacacagatgcctaggagcagcgagttggtatatgaaaagtctcccaccttttctcctaaaacttctctcctttctctccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaaatgtcattcacctattttaaagccatgttttagcactttttaggccaaagaaggtctgatagtgcctgtttttatgttctgtactctcacaaactttgttactcaaaattattgcatggcaggagagattggattatttatttcttatatttttataagtaaaaaaatctttctaaacaacaaatacctaacattattactgattgttttcctaatttatcctcctaagttgaatggtaacaaagcttttccagctgaatgaatgcacttagctgataaaccagaatttgttcttttttttccttcttttttttttgagacaggttctcactctgtcaccgaggttggagtgcagtggtatgatcatagctgactgcagcctcaaccttctgggctcaaatgatcctttcacctcagcctcctgagtagctgggaccacaggtgtgtgccaccacacctggctaatttttatggatttttttttcttttttttttttcgccatgttgcccaggctggtcttgaactcttggcactcaagcagtccttctgcctcagcctcccaaagtgctgggattacagatgtgagccactgcacctggccccagaaattatgcttaaaaaaaaaattaagctgtgtggaatctggacaaggctatgtttctcctagaaacaggttttgctgtaaatggttttgatgggcgaaagtgtgagaaaaggttataatagattcttttttttaattttgtgagaaattccaggtcttcttgcttaacttatatgcatgtggatatatttgttttcaaagccatggaagaatctctgttcatatattttaatgcaaattaccttgtatgctgctatgcaaattctattaaaaggcctacctgcttaagaattaaacatttttgaaactttcagggaagacctgtagactcaagcactttctctgcttttttgtatcttatcttggacacttatgctgaattatgttcttattattttcactggttataagctattccttgtacataatatttaaactatccaaatatccagcatacatttccatgtggctgccatcggctgttgatgccatgaatgaaatggctggttagaaagccaaaggtcttcttttttcaattcctaatgaataagtaaaatgccagatctctttggtctcaaagcaaattgctctgatcagatcaaatatctatgtaatgaaaagagacttacttaaatttgggattctgcttaaactttaagttgaatttgactgtagtcattcattctttttatatatctctgtcaggtatgacattaattaccaggtggtattatactctactttgagtttggacatcactttcagttaaatttctgttgttattgtggcttttttttttttttaaccccactgaagatggaagtagagcagtctgccatctcctgctgttctttctctgtgccccctaattgcttggtaatctaaaattattctgactttccacatactgtctttaaaaaccaattgtagcaatctgcccgcctccaccctttaagctaaatctttcactgtgctggatacatagacactcgataaatgtgtgatgatagttctaaaataattatgctatatatcagggttctgtatttttgagcaatatcattattcctatgctgtgatgttaaatggaatttattttacactagtaatagactgcttaagtggctgatttgaaacctttctctaaaaaaacaaaaacatctggcagatgagtgacacaaattcattctcttaaaggatagaatttcaagttaaggataaggcacaataaataggcacatagaggacatctgtttttgtttttggttttggttttgtttttttttgtctctctgactagctaaactgccaactagaagaatggttgttatgtagtaactcagaagaatcttttaataagtttcttcttttgtttcaaaacaaacttgagcttcatttcttgccacctctattctttcttcccacgttgggtgactgaactgatgcttattctagttttagaagaggatccacatttaatgtaaggcataaatatgccttttgcaaattattgcttgttctccagtgaacatttgatcatattcaacagaaatccaccatataaaccataatccttgaattgccccttttaaaatagattggttaaaaccaaaaacctataagagagaaatgatatttcattgtattgtaggtttgggaatcctggttagatttataatttctggccgggtgcggtggctcatgcctgtattcccagtactttgggagcccaaggtgggtggatcacctgaggtaaggagtttgagaccagcctggccaacatggtgaaaccccatctctactaaaaatacaaaaagttagctgggcatggtggtgcgcgcctgtggtcccagctactcgggaggctgaggtgggagaatcccttgaacccaggaggcagaagttgcagtgagctgagatcatgccattgcactccagcctgggcaacagagcgagacttcatctccaaaaaaagaaaaagaagaaaaagatttataatttctgagtcccctaagtccctttctcagtttgcaataatcttacgtccatgctattgacactaattttgaaactggaaagctaattaatgacatattcatgtgttctttcatctaataaacatttattaatgtatagttctacaccaggcattctgaagggtccaaaagaaagttcctgccctctagtagcacataatccgttatttctcagcacaccatgccatctgtttatcattcagcagttaagtaattcatcacttcatatttttaccaaagtatatttacaagtctgtttatctggatctggcaaactggaaaatgtttgaagggatactcaggctttgatccatgccaacatgaaaggactccaagcacatttaagtaggctggtcttttcatcatgcatgattttttttttagtgcaaatttagactttagtttgggaaagagaacagtatacagtatcctttgtaagataaatcacaacaacaaaaattaagttttattgcacaaagtagataaatgagaaagtctttcttaaaaaatgcttctttaactgtaacagcaaaactaaatgcatattttatcaaccccttatttctaattgctgtattcatttccacccttaaactatttaagcatttcatctgctgaaagtccttatatacatggtagacggaatatttctccattaatgatagatcaaaatgaagatatttaaaaattaacaaaatcaggccaaggcaggaggatcactttagcccaggaggtccagaccagcctgggcaacacagcgggaccccgactccatttaaaaaattaaaaaaaaaaaaaaaacttttaacatttaaaaaataaaaattaacaaaatttcacttattccaggacacgctggcatttggactcaatgaaaagggcacctaaagaaaataaggctgactgaatgttttccataattttcacacaataacagtccctttctatccagcttgccttccatttatctctagggttagcttttcaggcaacatccttggtcattgcccagaaagtacctgagctatcagtgattggaatggcacaggaaaccgaatcacatgggtgccctccccttggttttcaagtatcttggagttgtgcacaaaaattaggtcatgccttcagtgtcttgttctttaaacctaccctttgacaatcaggtgctaatgattgtatactattaaaaccagcacataagtattgtaaatgtgtgttcctcctaggttggaagaaatgtctttccttctatctgggtcctgttaaagcgggtgtcagttgtgtcttttcacctcgatttgtgaattaatagaattggggggagaggaaatgatgatgtcaattaagtttcaggtttggcatgatcatcattctcgatgatattctcactttgtcgcaaatctgcccttatcgtaagaacaagtttcagaattttccctccactatacgactccagtattatgtttacaatccattggatgagtgcagcattataagaccttggtgcccagaaaaatctgtcctttttggtaccaaacctgaggtcttttggaagataatgtagaaaaccactacctattgaaggcctgttttggctaatctgtgcaaactctgatgatacctgcttatgtggattcttttccacactgctttcatttttaagtataaagacttagaaaactagaataatgcttttacaaataattaaaagtatgtgatgttctgggttttttccttctttttagaaccctgtatttaaacaagccttctttttaagtcttgtttgaaatttaagtctcagatcttctggataccaaatcaaaaacccaacgcgtaaaacagggcagtatttgtgttcctaattttaaaaagctttatgtatactctataaatatagatgcataaacaacacttccccttgagtagcacatcaacatacagcattgtacattacaatgaaaatgtgtaacttaagggtattatatatataaatacatatatacctttgtaacctttatactgtaaataaaaaagttgctttagtca

SEQ ID NO: 30840 - DNA, 1505 bp, Homo sapiens
cgacatcctttgtggtgccacagcacatggatttcagaaccgcctgtgaggagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgaaagaacggtgaccatcagaagacaaacagtaggaggatttggattaagcataaagggaggagcagaacataacattccagttgtcgtttcaaaaatctccaaggaacaaagagcggaactttcaggactactttttattggagatgcaattctacagataaatggcattaatgtgagaaaatgtagacatgaagaagtggttcaggttcttcggaatgctggagaagaagtgactctaacagtgtcatttttaaaaagagcacctgctttcctcaaactcccattgaatgaagattgtgcatgtgctccaagtgaccagagcagtggcacctcctctcctctctgtgacagtggcttacatctcaactaccatcccaacaatacagacacattatcatgctcgtcgtggccgacgtctccaggcttgaggtgggagaagcgatggtgcgacctcagactgatccctctacttcattcgcgcttctctcagtatgtgcccggcacagatttgagtcggcagaatgcctttcaagtcattgctgtggatggggtctgcactgggattattcagtgcctctctgctgaagactgcgttgactggctacaagcaatagcaactaacatttcaaatctcacaaagcacaatattaaaaaaatcaacagaaactttcctgtaaaccagcagattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttgacatactgaactcttcattgacacaccccatgactgt

SEQ ID NO: 30841 - DNA, 1703 bp, Homo sapiens
ttagaagctctgagaaatcatgggccgtgcggtaggggttgaaatgctcaaaggtccacacttcttgaaataaacagaatggtcttgagtggattgcaactgttttggaaatagctttgtgaaaagagggtggagagctactcaaaattctacgttagagagactgaaaagacatctaatttcattgctcggcagacgacatcctttgtggtgccacagcacatggatttcagaaccgcctgtgaggagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgaaagaacggtgaccatcagaagacaaacagtaggaggatttggattaagcataaagggaggagcagaacataacattccagttgtcgtttcaaaaatctccaaggaacaaagagcggaactttcaggactactttttattggagatgcaattctacagataaatggcattaatgtgagaaaatgtagacatgaagaagtggttcaggttcttcggaatgctggagaagaagtgactctaacagtgtcatttttaaaaagagcacctgctttcctcaaactcccattgaatgaagattgtgcatgtgctccaagtgaccagagcagtggcacctcctctcctctctgtgacagtggcttacatctcaactaccatcccaacaatacagacacattatcatgctcgtcgtggccgacgtctccaggcttgaggtgggagaagcgatggtgcgacctcagactgatccctctacttcattcgcgcttctctcagtatgtgcccggcacagatttgagtcggcagaatgcctttcaagtcattgctgtggatggggtctgcactgggattattcagtgcctctctgctgaagactgcgttgactggctacaagcaatagcaactaacatttcaaatctcacaaagcacaatattaaaaaaatcaacagaaactttcctgtaaaccagcagattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttgacatactgaactcttcattgacacaccccatgactgtat

SEQ ID NO: 30842 - DNA, 1925 bp, Homo sapiens
cccttccagccggagctcgcgagccgcggtggcggctggtggccaccccagggaaataaagccgttgctgctgcagcaaaatggctcaaagtccaaccaaagtctggccttttcctgagcctaggctgtgggcgactcgctagcactgccctgggcctccaagctgcctgctcgctgagctcagcgctgacactcacaggagctgcgttcgccggatcctctgagaggctctgcaacgatcccgatccaattcagcagcgttttaaaagactgctctccagaatgttgagattgcccgagaagtgaccccagcaaaagaaaaatattgctgtacctaaattcaaacgacatcctttgtggtgccacagcacatggatttcagaaccgcctgtgaggagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgaaagaacggtgaccatcagaagacaaacagtaggaggatttggattaagcataaagggaggagcagaacataacattccagttgtcgtttcaaaaatctccaaggaacaaagagcggaactttcaggactactttttattggagatgcaattctacagataaatggcattaatgtgagaaaatgtagacatgaagaagtggttcaggttcttcggaatgctggagaagaagtgactctaacagtgtcatttttaaaaagagcacctgctttcctcaaactcccattgaatgaagattgtgcatgtgctccaagtgaccagagcagtggcacctcctctcctctctgtgacagtggcttacatctcaactaccatcccaacaatacagacacattatcatgctcgtcgtggccgacgtctccaggcttgaggtgggagaagcgatggtgcgacctcagactgatccctctacttcattcgcgcttctctcagtatgtgcccggcacagatttgagtcggcagaatgcctttcaagtcattgctgtggatggggtctgcactgggattattcagtgcctctctgctgaagactgcgttgactggctacaagcaatagcaactaacatttcaaatctcacaaagcacaatattaaaaaaatcaacagaaactttcctgtaaaccagcagattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggctgtcctttggaggtataaattctctcagcttaaaggttcttcagatgatggcaagagcaaaatcaaatttttgtttcagaatccagatactaaacagattgaagcaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttga

SEQ ID NO: 30843 - DNA, 3504 bp, Homo sapiens
ttaggggctcccgtccccttacttcagcaccagaggggatggacagcgtctccggactgagctgcagccacagggacggaactacgctgccgccgccgctgtccttgccgccactgtcgtcgccacgggcagctgggctacttgctcctcgcagctaaaaggcggtgcctcctattaccccctcgcctcccggcccccttccttaatggatgaaaagtacccctccctctacacctgctgtacctaaggacaggactctgaggagtactcttgctccacagattaaactctcagcagcaacttcaagaatcatttttctataggggtctgggaggaattctggaggagagtaaagtcgaagttcttagaagctctgagaaatcatgggccgtgcggtaggggttgaaatgctcaaaggtccacacttcttgaaataaacagaatggtcttgagtggattgcaactgttttggaaatagctttgtgaaaagagggtggagagctactcaaaattctacgttagagagactgaaaagacatctaatttcattgctcggcagactgctctccagaatgttgagattgcccgagaagtgaccccagcaaaagaaaaatattgctgtacctaaattcaaacgacatcctttgtggtgccacagcacatggatttcagaaccgcctgtgaggagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgaaagaacggtgaccatcagaagacaaacagtaggaggatttggattaagcataaagggaggagcagaacataacattccagttgtcgtttcaaaaatctccaaggaacaaagagcggaactttcaggactactttttattggagatgcaattctacagataaatggcattaatgtgagaaaatgtagacatgaagaagtggttcaggttcttcggaatgctggagaagaagtgactctaacagtgtcatttttaaaaagagcacctgctttcctcaaactcccattgaatgaagattgtgcatgtgctccaagtgaccagagcagtggcacctcctctcctctctgtgacagtggcttacatctcaactaccatcccaacaatacagacacattatcatgctcgtcgtggccgacgtctccaggcttgaggtgggagaagcgatggtgcgacctcagactgatccctctacttcattcgcgcttctctcagtatgtgcccggcacagatttgagtcggcagaatgcctttcaagtcattgctgtggatggggtctgcactgggattattcagtgcctctctgctgaagactgcgttgactggctacaagcaatagcaactaacatttcaaatctcacaaagcacaatattaaaaaaatcaacagaaactttcctgtaaaccagcagattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggctgtcctttggaggtataaattctctcagcttaaaggttcttcagatgatggcaagagcaaaatcaaatttttgtttcagaatccagatactaaacagattgaagcaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttgacatactgaactcttcattgacacaccccatgactgtataagcaggacacatttactcatcattttagaccctagagaaaccataacatcaccaagtcgacagtggaggcaaatcaaaatttcggcagaaaaagaaggtcatgtggaacctcaaaaacacttctattctggatgacatctgtgaaatatactacatgaacagaacagcttgttctcactcagttgctttgtaccagtaagtgtattgctttcaccaaaagtggagacaaaagaataaattatttgaagaagtatgtaaataacataaaaatagtaagctacctatgaataaaaatacttattaaatgattacttctgtattttagattattttgtatgactagtacatgttgggcagagtcataggaaaacaaatgccctatcttgtattatgagggacataaaagagttaaaaaccataaatcagcaaggagcatgcaaaaaaatctcatcaaagaaggatgcactttaatttgctgatgtaaatttgcccttgtgttctcatcccatgatttgacactggcattccaattgtttttatcttattgtaaatattccgaagaacttccaaaggataattacattgacccatgatagatacaatgtgaaatggactattctcccttggatcactgttattgaaatgtcttattagctgccaaagtcaatcaaatatgccaacagtgtattaatttaattatgagtgatggaaaatttcatgaacctctcatttcttccttggtttgaaagagatttgtattttacctaataagatttattatcaaattaaagtttcataaattttcagtgaacccaaaaccttttgtagagaaaataatataaacaaatatggtgtgagaaacaattctttgtaatccgaagtctactagttaatcatgaactaaaatgtcccccgaaaacagtcccaaagctattatagatgttaattaaatgacattttttcattttagtactattttatgagaaacaaaggtgatatttaaagataaaagttaaaattctttaacctcccttgtcatggaaagtgattaagtaatgccaactatgcaggttgttttaggtattttgtcctaagaatgtaaatgtgaaaggctgggaaatttgaaagccttagaggtgtgcaatttactcagattccaggtattattcaactagttgtataacatggaacacagtctctgtccttcagtacagcttttttgagatattttaaaaagtcagctgtgtatg

SEQ ID NO: 30844 - DNA, 548 bp, Homo sapiens
aaatagctttgtgaaaagagggtggagagctactcaaaattctacgttagagagactgaaaagacatctaatttcattgctcggcagtgaacactggacacgttggtgggagttgttctgtgctgagagcatagcaatgaatacagagacagcagacctgccttcacagactgctctccagaatgttgagattgcccgagaagtgaccccagcaaaagaaaaatattgctgtacctaaattcaaacgacatcctttgtggtgccacagcacatggatttcagaaccgcctgtgaggagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgaaagaacggtgaccatcagaagacaaacagtaggaggatttggattaagcataaagggaggagcagaacataacattccagttgtcgtttcaaaaatctccaaggaacaaagag

SEQ ID NO: 30845 - DNA, 1087 bp, Homo sapiens
gggaggagcttgcttctccattctggtgtgatccaggaacagctgtcttccagctctgaaagagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaata

SEQ ID NO: 30846 - DNA, 1096 bp, Homo sapiens
gaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattc

SEQ ID NO: 30847 - DNA, 1420 bp, Homo sapiens
agagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacaggttagcgggtttgcctcccactcccccagcctcgcgtcgccggctcacagcggcctcctctggggacagtcccccccgggtgccgcctccgcccttcctgtgcgctccttttccttcttctttcctattaaatattatttgggaattgtttaaattttttttttaaaaaaagagagaggcggggaggagtcggagttgtggagaagcagagggactcagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaata

SEQ ID NO: 30848 - DNA, 3173 bp, Homo sapiens
aggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttacgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaataaaaaaaaaaaaaaagtgggttcccgggaactaagcagtgtagaagatgattttgactacaccctccttagagagccataagacacattagcacatattagcacattcaaggctctgagagaatgtggttaactttgtttaactcagcattcctcactttttttttttaatcatcagaaattctctctctctctctctctttttctctcgctctctttttttttttttttttacaggaaatgcctttaaacatcgttggaactaccagagtcaccttaaaggagatcaattctctagactgataaaaatttcatggcctcctttaaatgttgccaaatatatgaattctaggatttttccttaggaaaggtttttctctttcagggaagatctattaactccccatgggtgctgaaaataaacttgatggtgaaaaactctgtataaattaatttaaaaattatttggtttctctttttaattattctggggcatagtcatttctaaaagtcactagtagaaagtataatttcaagacagaatattctagacatgctagcagtttatatgtattcatgagtaatgtgatatatattgggcgctggtgaggaaggaaggaggaatgagtgactataaggatggttaccatagaaacttccttttttacctaattgaagagagactactacagagtgctaagctgcatgtgtcatcttacactagagagaaatggtaagtttcttgttttatttaagttatgtttaagcaaggaaaggatttgttattgaacagtatatttcaggaaggttagaaagtggcggttaggatatattttaaatctacctaaagcagcatattttaaaaatttaaaagtattggtattaaattaagaaatagaggacagaactagactgatagcagtgacctagaacaatttgagattaggaaagttgtgaccatgaatttaaggatttatgtggatacaaattctcctttaaagtgtttcttcccttaatatttatctgacggtaatttttgagcagtgaattactttatatatcttaatagtttatttgggaccaaacacttaaacaaaaagttctttaagtcatataagccttttcaggaagcttgtctcatattcactcccgagacattcacctgccaagtggcctgaggatcaatccagtcctaggtttattttgcagacttacattctcccaagttattcagcctcatatgactccacggtcggctttaccaaaacagttcagagtgcactttggcacacaattgggaacagaacaatctaatgtgtggtttggtattccaagtggggtctttttcagaatctctgcactagtgtgagatgcaaacatgtttcctcatctttctggcttatccagtatgtagctatttgtgacataataaatatatacatatatgaaaata

SEQ ID NO: 30849 - DNA, 1290 bp, Homo sapiens
gacaaatcagcggtgggggcggagagccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaata

SEQ ID NO: 30850 - DNA, 3127 bp, Homo sapiens
gccattcgacgacaggttagcgggtttgcctcccactcccccagcctcgcgtcgccggctcacagcggcctcctctggggacagtcccccccgggtgccgcctccgcccttcctgtgcgctccttttccttcttctttcctattaaatattatttgggaattgtttaaattttttttttaaaaaaagagagaggcggggaggagtcggagttgtggagaagcagagggactcagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttacgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaataaaaaaaaaaaaaaagtgggttcccgggaactaagcagtgtagaagatgattttgactacaccctccttagagagccataagacacattagcacatattagcacattcaaggctctgagagaatgtggttaactttgtttaactcagcattcctcactttttttttttaatcatcagaaattctctctctctctctctctttttctctcgctctctttttttttttttttttacaggaaatgcctttaaacatcgttggaactaccagagtcaccttaaaggagatcaattctctagactgataaaaatttcatggcctcctttaaatgttgccaaatatatgaattctaggatttttccttaggaaaggtttttctctttcagggaagatctattaactccccatgggtgctgaaaataaacttgatggtgaaaaactctgtataaattaatttaaaaattatttggtttctctttttaattattctggggcatagtcatttctaaaagtcactagtagaaagtataatttcaagacagaatattctagacatgctagcagtttatatgtattcatgagtaatgtgatatatattgggcgctggtgaggaaggaaggaggaatgagtgactataaggatggttaccatagaaacttccttttttacctaattgaagagagactactacagagtgctaagctgcatgtgtcatcttacactagagagaaatggtaagtttcttgttttatttaagttatgtttaagcaaggaaaggatttgttattgaacagtatatttcaggaaggttagaaagtggcggttaggatatattttaaatctacctaaagcagcatattttaaaaatttaaaagtattggtattaaattaagaaatagaggacagaactagactgatagcagtgacctagaacaatttgagattaggaaagttgtgaccatgaatttaaggatttatgtggatacaaattctcctttaaagtgtttcttcccttaatatttatctgacggtaatttttgagcagtgaattactttatatatcttaatagtttatttgggaccaaacacttaaacaaaaagttctttaagtcatataagccttttcaggaagcttgtctcatattcactcccgagacattcacctgccaagtggcctgaggatcaatccagtcctaggtttattttgcagacttacattctcccaagttattcagcctcatatgactccacggtcggctttaccaaaacagttcagagtgcactttggcacacaattgggaacagaacaatctaatgtgtggtttggtattccaagtggggtctttttcagaatctctgcactagtgtgagatgcaaacatgtttcctcatctttctggcttatccagtatgtagctatttgtgacataataaatatatacatatatgaaaata

SEQ ID NO: 30851 - DNA, 728 bp, Homo sapiens
cagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaaggtatggctgtgtacgttttgtgttacatttataagctggtgagattacggttcattttcatgtgaggcctggaggcaggagcaagatacttactgtggggaacggctacctgaccctccccttgtgaaaaagtgctacctttatattggtcttgcttgtttcaggcattaacccagataaatgccatgcaaattttataattattatgattgtttcaatttctggaagaaagttaatgaaacaaaaaatgtagtaaaatgccaaaggaacagtgacatttcagaaagaatgagggctttcatgttaattgtaagtcttggaatttctcttccttggagtaacaaatccctttgtgcctaatttcctaatttccaaaataaagttcttttactta

SEQ ID NO: 30852 - DNA, 411 bp, Homo sapiens
taaaggaattcattagccatggatgtattcatgaaaggactttcaaaggccaaggagggagttgtggctgctgctgagaaaaccaaacagggtgtggcagaagcagcaggaaagacaaaagagggtgttctctatgtagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttg

SEQ ID NO: 30853 - DNA, 570 bp, Homo sapiens
ggaggacggcgacgaccagaaggggcccaagagagggggcgagcgaccgagcgccgcgacgcggaagtgagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcc

SEQ ID NO: 30854 - DNA, 387 bp, Homo sapiens
gaccccggcccggcccctccgagagcgtcctgggcgctccctcacgccttgccttcaagccttctgcctttccaccctcgtgagcggagaactgggagtggccattcgacgacagagagaggcggggaggagtcggagttgtggagaagcagagggactcagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttgg

SEQ ID NO: 30855 - DNA, 905 bp, Homo sapiens
gatagctgagggcgggggtggatgttggatggattagaaccatcacacttgggcctgctgtttgcctgagtttgaaccacaccccgatgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagattttta

SEQ ID NO: 30856 - DNA, 3745 bp, Homo sapiens
gcggccgcccaggctgcccccgcccgcgcgcgcccgttggggggcccggggagcggcgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgttctgatttctaagggactttgcaagtattttgattgctgatatttgatttcaggaacaaactgctcagtttagcagttttcccataggcgtcaaataaaacattctatatttcattaagta

SEQ ID NO: 30857 - DNA, 3781 bp, Homo sapiens
cgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatctgacaataggagtcaagggaacaggctacaaaagcttggattggaggacacagacagggaagatgcaatgggctttggttcccatagggccaaactgacagtagttgctgccctgggagcttgccattgtcctgagaatgagtattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagaaatgtacagcagctgcatcaatctttcctctaacatgctgattgaagagcatctgtgtaacgacacacggcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgtt

SEQ ID NO: 30858 - DNA, 3389 bp, Homo sapiens
cgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgtt

SEQ ID NO: 30859 - DNA, 2588 bp, Homo sapiens
cgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagaaatgtacagcagctgcatcaatctttcctctaacatgctgattgaagagcatctgtgtaacgacacacggcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgtt

SEQ ID NO: 30860 - DNA, 1972 bp, Homo sapiens
agtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatg

SEQ ID NO: 30861 - DNA, 1474 bp, Homo sapiens
agtgctgttctgcgtcccaggctggtccgcgtggatttcagaggggaatgtttctctcttggccttgtctcttggcgatgactttcatctgcaggtggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaactt

SEQ ID NO: 30862 - DNA, 3123 bp, Homo sapiens
atggaagcccctgaataccttgatttggatgaaattgactttagtgatgacatatctgacaataggagtcaagggaacaggctacaaaagcttggattggaggacacagacagggaagatgcaatgggctttggttcccatagggccaaactgacagtagttgctgccctgggagcttgccattgtcctgagaatgagtattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagactagactcaagattcaagggacttggaatgggagtgagacatgcctttttacacaccactttagctcctatccccctatctcttctgggctgcagtgtcaaggacaagaaggagttctttttattcctgatcaggttggcgcagcaacaaataaacaggtgttatttcaaaaccaattaccagagaccaaatccagttactagagcccaagcaaatgagaacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagta

SEQ ID NO: 30863 - DNA, 1885 bp, Homo sapiens
atggaagcccctgaataccttgatttggatgaaattgactttagtgatgacatatcttattcagtcacatcactcaagacgatcccagaactgtgccgaagatgtgatacgcaaaacgaagacagatcagccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagta

SEQ ID NO: 30864 - DNA, 420 bp, Homo sapiens
agtcgaggtaaaaagagcgaaaggtaaagaaagagcaggttcgtggacaggagccggcgggcaggccgggggatccctggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaaga

SEQ ID NO: 30865 - DNA, 559 bp, Homo sapiens
attgttcttttcatttgcccgcctcatgtggttcttattcttgctgtcacccgggatcttatcgcaggcagggatgggcagttccgcggctcggaaaagctgagataaggaggggcgaagtaatagtaatagcgacagtactaacaacggtaataatagctgtagaaaagggacgtctggtgttgctgccgcccctcgctcatcagcaccagctccccgactgccctgtccagcccgggctccgccagcctccctctagtgctgttctgcgtcccaggctggtccgcgtggatttcagaggggaatgtttctctcttggccttgtctcttggcgatgactttcatctgcaggtgagacagggtttcaccatgttgcccaggctggtctcgaactcctggactcaagcagtctgtccatctcagcctcccaaagtgctgggattacaggtgtgagccaccacactggccaaggaatttataagtatttgaccgtactcaaaatgtgcaaggaagaataatggaagcccctgaataccttgatttggatgaaattgacttt

SEQ ID NO: 30866 - DNA, 723 bp, Homo sapiens
gagcacagaacattccaggcaggcaaagccacccttgccctcctctccttggccacgtcctcaggggtgggcgagcttcggggggaggggtgggggtgaagactccgtgccaacgcaaaatactctgccaaaaggcttctcagacatgagtttcccagggcaatgcccaccttccgttccccgccttcccgagtctcttctcccagtttatgctggaaccctggaatggtctggggaccaatgagatggcagcggttaacgcttggatcacggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgag

SEQ ID NO: 30867 - DNA, 2359 bp, Homo sapiens
aaagtgggaagcgcggacaaaaagtaggcggggaggagaggagagccccagctggggaaaagcaacggcagtcgaggtaaaaagagcgaaaggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccagtcagagattcaaggattttcaattcacatctgaatgagaattttctcttgctacggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcag

SEQ ID NO: 30868 - DNA, 1383 bp, Homo sapiens
ggtccaccccggcctggcctagcggagcccccgcgtccgcccgccgcagccgccgctccatccccagccccggccccgcatccaggcgggtcctggatattcgcgccgaacccagcactccggttcgacggggctgcagtttgcagggcccggataaccgaggcagtggcccctcccgcgtccccaggtttcaaggacgctaggactctccgcggccctgaggcttcgcactggggagtggggccgccaggatggacgtgttcatgaagggcctgtccatggccaaggagggcgttgtggcagccgcggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaagagggaggaattccctactgatctgaagccagaggaagtggcccaggaagctgctgaagaaccactgattgagcccctgatggagccagaaggggagagttatgaggacccaccccaggaggaatatcaggagtatgagccagaggcgtaggggcccaggagagcccccaccagcagcacaattctgtccctgtccctgccccgccccccagagccagggctgtccttagactccttctccccaatcacgagatcttccttccgctctgaggcaaccccctcggagcctgtgttagtgtctgtccatctgtctgtcctacccgcccgcgtccaaccccggggcatggacagggccagggttgcggtcgcggctgggagcctcgcccctccagtgttgcctcctcccatccagcgtctgcgcggatgtagcatgttctatgtgtttttaaacgaagatccgagcgacggctcctccccgatccccgacagtggctctccaagcggcccccgggcagccccagagcaccccgcccgactcccattaacctcgagaacctttttttttttaaccaaaaccaggagccaggctgtgccatgtcccccgccccccatcccagccggcccggtccgaacgcgggcgtcgtgtgttgtgattgtggcatggagagtccccatcccccccatgtgagcgtgtcccgggcgggtgggcccggccgcccccgagagtccatgaataaagctaatctgtctgtagccagagccgcaccggcagggctgggctgggcgccgggtgggggcgacacgtggcggcgagtcttccaggtcccagcctacccctctgtgctctttggggtctggcacacacagcccaggtacaa

SEQ ID NO: 30869 - DNA, 1234 bp, Homo sapiens
tgccgcagcgccggagccggagccggagccggagcgcgcgagctcgcagggcgcgaggaacgagcggtggctggctacgcacccgagacccgggcactgctgcgctcctgctcaggacccgcgacccgagcgcctgatcccggccctatcccccctccggcccctggtccaccccggcctggcctagcggagcccccgcgtccgcccgccgcagccgccgctccatccccagccccggccccgcatccaggccgccaggatggacgtgttcatgaagggcctgtccatggccaaggagggcgttgtggcagccgcggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaagagggaggaattccctactgatctgaagccagaggaagtggcccaggaagctgctgaagaaccactgattgagcccctgatggagccagaaggggagagttatgaggacccaccccaggaggaatatcaggagtatgagccagaggcgtaggggcccaggagagcccccaccagcagcacaattctgtccctgtccctgccccgccccccagagccagggctgtccttagactccttctccccaatcacgagatcttccttccgctctgaggcaaccccctcggagcctgtgttagtgtctgtccatctgtctgtcctacccgcccgcgtccaaccccggggcatggacagggccagggttgcggtcgcggctgggagcctcgcccctccagtgttgcctcctcccatccagcgtctgcgcggatgtagcatgttctatgtgtttttaaacgaagatccgagcgacggctcctccccgatccccgacagtggctctccaagcggcccccgggcagccccagagcaccccgcccgactcccattaacctcgagaacctttttttttttaaccaaaaccaggagccaggctgtgccatgtcccccgccccccatcccagccggcccggtccgaacgcgggcgtcgtgtgttgtgattgtggcatggagagtccccatcccccccatgtgagcgtgtcccgggcgggtgggcccggccgccccc

SEQ ID NO: 30870 - DNA, 552 bp, Homo sapiens
gtgcatgaccgtgtgactgtgccgtgcgtgtacaggcgggtcctggatattcgcgccgaacccagcactccggttcgacggggctgcagtttgcagggcccggataaccgaggccgccaggatggacgtgttcatgaagggcctgtccatggccaaggagggcgttgtggcagccgcggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaagagggaggaattccctactgatctgaagccagaggaagtggcccaggaagctgctgaagaaccactgattgagcccctgatggagccagaaggggagagttatgaggacccaccccaggaggaatatcaggagtatgagccagaggcgtaggggcccaggagagcccccaccagcag

SEQ ID NO: 30871 - DNA, 730 bp, Homo sapiens
gaccgtgtgactgtgccgtgcgtgtacaggcgggtcctggatattcgcgccgaacccagcactccggttcgacggggctgcagtttgcagggcccggataaccgaggcagtggcccctcccgcgtccccaggtttcaaggacgctaggactctccgcggccctgaggcttcgcactggggagtggggccgccaggatggacgtgttcatgaagggcctgtccatggccaaggagggcgttgtggcagccgcggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaagagggaggaattccctactgatctgaagccagaggaagtggcccaggaagctgctgaagaaccactgattgagcccctgatggagccagaaggggagagttatgaggacccaccccaggaggaatatcaggagtatgagccagaggcgtaggggcccaggagagcccccaccagcagcacaattctgtccctgtccctgccccgccccccagagccagggctgtccttagactccttctccccaatcacgagatcttccttccgctctgaggcaaccccct

SEQ ID NO: 30872 - DNA, 684 bp, Homo sapiens
caagcccgcagctcgcagggagatccagctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggagccaagaccaaggagaatgttgtacagagcgtgacctcaggcctgccttggggctggggctggggtggaggccagccagtgtcctcccatagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggaggacttgaggccatctgccccccaacaggagggtgaggcatccaaagagaaagaggaagtggcagaggaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccct

SEQ ID NO: 30873 - DNA, 701 bp, Homo sapiens
agctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggagccaagaccaaggagaatgttgtacagagcgtgacctcagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggaggacttgaggccatctgccccccaacaggagggtgaggcatccaaagagaaagaggaagtggcagaggaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacttatgctgctgtgaattttttttttaaatgattccaaataaaacttgagcccactcctgc

SEQ ID NO: 30874 - DNA, 2862 bp, Homo sapiens
ttctgcgcatgtgctcagttcgctatccggctgcttgtacctggttcaggaggttcaggcagaggttgcacccactacgcctgcgcaacctcagccccgcccctccgctgctttccccggaaacgtttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtttgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccctgggacagctgttacctttgcagtgttgccgaatcacagcagttacctttgcagtgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagcgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttctgcctgcacttactttgtaatgccacggttgagattgagagagatcagcgcagccaggcaagggaactttaaagaattattaggccaccttctccctttcctggaccccagagtcattcctccatttggttaaaatactcagtgcagggaactcttacatcctgtctccttcacttgcagcgtcccctgctatgcctcaggtgaaccacataattcttgggtttccgttcctacttgctagtgatttctgaacatgttcaatggagcggcacacagtctagacccacttccgcattgaaaccttcactgttcctctttggtttcttcagagctttcccaagagagctgtcagttttcagctgtcagtaacacaaatgagtttatggtaacacaaatgagttttgctatctctctgagaagctcatctgacctcctgactctcagccctacagagtagggagttgatgctgacaggatgaagatttaggaataaatatgcctgggaagagactgggaaggttctagggtgaggcacctcagtaactcatggtaccttggccaagttggaaggaagcagtttgttaatgaggcacagtaatcctggctgcagggtctaggaggtaagaccagctgggatgaccttccctgggttaatcaatttccctctagacaacacaaactgcaggcatgtgactaactttgaaagaacacccatcatgtggctgctgtcacccttgaccagccgtggtggtggttactccatctgtggttggagcgcctctttgggattcacttcaaggtcttgtgcctatttttctgcatatcttctgtgatgacaaatctctgtcccctgagtgttaatttgatttttagaaatggccaaaagtcacgtgatccaaactttttttcagtaatatggagactgagctgcatggtagttggggatcaaaaatatgtgaccttaatgagatttttatgatttctaaagtaacaataaaagcagtttttagagttgagttccagagagggcagggcaatggcagtgacatgtttgtcattttaataataaataacatctattgagtgcttaagaggtg

SEQ ID NO: 30875 - DNA, 813 bp, Homo sapiens
ctggaacaacttacttcccgtctttccacttcagagagggggaacctaggatcaatgaagttgatgggttttcgtctgctggagtaggaataaccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaacc

SEQ ID NO: 30876 - DNA, 433 bp, Homo sapiens
agtccctcctcccgggcggggcgacgttgccatggagacaggccgctggctgaggcccggctcgtgtccctgcagggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacct

SEQ ID NO: 30877 - DNA, 2915 bp, Homo sapiens
tttccccggaaacgtttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgacagggtcttgctctcttgcccaggctggagtgcagtggcgaagtcacagctcactgcagcctcgactcctgggcttaagcgatcctccgacctcagcctcctgagtagctgatactacaagcgcaaggcaccacatctggctaatttttaaattttttgtagagacagtgtctcattatgttgcccaggatggtcttgaactcctggcctcaagcagtcttcctgcctcgacctcccaaggtgctgggattacaggcgtgagccaccatgcctagcctgttcagagtaaatcttatttgaggcatgaatcaatcaaacataaatagagagttgaattgatcttagagggaatgggatgcagcaaagccctacttgaccatctcccccctcccacatttggaaatccttaaacccacttatgtaggcctctgactgtgagattcagagccacagcagtttccacctctgctaaggccttcaggcagtgagatggctcacttcagtgcccctccttccacacatctcctagctgtatcctgagacgcctcaacctagtcactacccttctgtatgatgttggtctaaggcttccccctctctggacatgaaggcggagcctcccagcactaccagccacacaccactcaagactccagatcctgaaccctgactctggggcccagctctgggcctggcttggggcttgcatctcacctagcctggcagtgttgttgtcacacccaccttgtatggatgccacataggcatttcaagtgatgcggagcagaagcgggtgcagcggcgcttgacccaacgcagggtggaggatctgcacatcaccctgggcgccgggaggtggattcgtgtgggcagcccctcaaaccagatccactggtcggctacatccagctgcttcatgtgccccatgggagttctattgcggtagggcttaatgaagatgactcgggggccctcggtgagtggttgcctcccctggactccagggttcaagctatcatccctcgatgtccttggaacctcaggctctatatgcttttctttccgtggcattgccgccaatgacgttttctccttgttcctcatccctgactgcacctgggacttccactccttgtactcttttttcttagggtcccctgtggactctaatttcttggacttgagttccttctcggagcacccgatctcctggaactcttcattattttgttttgttttattgcaggcactgttttccctggcagggagaggaaaggcagtcagcacagcaggaccgaggccctggttcccgagacagttgctatgtagccagctcaggggagcctgttaagaaaggctagaggggcctgcaaagaaacttctctactgcccagaggccttgtgctggtgtgaggaggtgtgatgagcactagcagagggatgtgagagattgggaaggtgaaagccatgactagtagttaaggcccctaagaatgaatattgtctacatcatctgccactagattagggttctgtctctctggacttcagctgggagggtgaacagtccagtagtttttctaaattgtgctccaagaaccttagggttctgaggaggtgtctcaatgtcacctcccctgacccactggggcaggatacctctccccagctcataacaacacaattggggcttggaaatagatatttgaacagaggtttcactgctttaataaagttggaaaactgttcaagaccagcctgggcaacatggtgagactctgtctccatacaaaaaaaaaatttttaagttggaaaatgatggggctagatgatcctgatccttctagctctatgtttcctgattgcctgcgactagaggccaaatcagaaagaggagcccagaaaggtggccttgacagaaatattaaatgctgagactttcccaaagggtgtctgtaacagactgggccccctgcaaacccccagtggcaacaccatcctagccaagggcgtggagagagatgaggccttgggctgcagataatggcaatactgtgatgataataatggctcccgctgattgagtcctcgctctatgccagactcgggacccttacaacttgggatccttactatttctgtgaagtagaaggcagtgaaacagagtggcttacagagcacaggtgttggattcagacaaacgggctcagattctgcttctgcctcttaccacctgtgtgatttgggcaagatatttaacctctcagagccttagcttccttatctgtaaaactaggataattctgtctacctaacaggattgttgtgaagaataaactaaatgggaaaattcttaagtgcttaacactgtaggatggtacttagcaggcaccaatcaatgttagctttcttaatactgtcatgtgacttatgaggaaacggtttgaacttgtctcggaggcatggtaaaaaaaaataaaaataaaaataaattaataaagaaa

SEQ ID NO: 30878 - DNA, 2250 bp, Homo sapiens
ggcaacaagtcctgtttttataagagagcgaggaggacacttctcagaaggggttgttttgcttttgcttatttccgtccatttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactgcggcgagacgagcgcggcgcatcccaaagcccggccaaatgcgctcgtccctgggaggggagggaggcgcgcctggagcggggacagggcggcggccaagagcagggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttgggggtccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatcctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagcggtgctgtcccaggtggcttacagatgaacccaactgtggagatgatgcagttggcccaacctcactgacggtgaaaaaatgtttgccagggtccagaaactttttttggtttatttctcatacagtgtattggcaactttggcacaccagaatttgtaaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcaaaataaacgcaatatgcaaaa

SEQ ID NO: 30879 - DNA, 2967 bp, Homo sapiens
cgtcctatctgcagtcggctactttcagtggcagaagaggccacatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctggcagtttgagcagatcctatgtctctgagagacacattcctcataatggccagcattttgggctacaaggttttgtggttgatgatgaggatggcatgactgcagagccatcctcatctcattttttcacgtcattttcagtaactttcactcattcaaaggcaggttataagtaagtcctggtagcagcctctatggggagatttgagagtgactaaatcttggtatctgccctcaagaacttacagttaaatggggagacaatgttgtcatgaaaaggtattatagtaaggagagaaggagacatacacaggccttcaggaagagacgacagtttggggtgaggtagttggcataggcttatctgtgatgaagtggcctgggagcaccaaggggatgttgaggctagtctgggaggagcaggagttttgtctagggaacttgtaggaaattcttggagctgaaagtcccacaaagaaggccctggcaccaagggagtcagcaaacttcagattttattctctgggcaggcatttcaagtttccttttgctgtgacatactcatccattagacagcctgatacaggcctgtagcctcttccggccgtgtgtgctggggaagccccaggaaacgcacatgcccacacagggagccaagtcgtagcatttgggccttgatctaccttttctgcatcaatacactcttgagcctttgaaaaaagaacgtttcccactaaaaagaaaatgtggatttttaaaatagggactcttcctaggggaaaaaggggggctgggagtgatagagggtttaaaaaataaacaccttcaaactaacttcttcgaacccttttattcactccctgacgactttgtgctggggttggggtaactgaaccgcttatttctgtttaattgcattcaggctggatcttagaagacttttatccttccaccatctctctcagaggaatgagcggggaggttggatttactggtgactgattttctttcatgggccaaggaactgaaagagaatgtgaagcaaggttgtgtcttgcgcatggttaaaaataaagcattgtcctgcttcctaagacttagactggggttgacaattgttttagcaacaagacaattcaactatttctcctaggatttttattattattattttttcacttttctaccaaatgggttacataggaagaatgaactgaaatctgtccagagctccaagtcctttggaagaaagattagatgaacgtaaaaatgttgttgtttgctgtggcagtttacagcatttttcttgcaaaattagtgcaaatctgttggaaatagaacacaattcacaaattggaagtgaactaaaatgtaatgacgaaaagggagtagtgttttgatttggaggaggtgtatattcggcagaggttggactgagagttgggtgttatttaacataattatggtaattgggaaacatttataaacactattgggatggtgataaaatacaaaagggcctatagatgttagaaatgggtcaggttactgaaatgggattcaatttgaaaaaaatttttttaaatagaactcactgaactagattctcctctgagaaccagagaagaccatttcatagttggattcctggagacatgcgctatccaccacgtagccactttccacatgtggccatcaaccacttaagatggggttagtttaaatcaagatgtgctgttataattggtataagcataaaatcacactagattctggagatttaatatgaataataagaatactatttcagtagttttggtatattgtgtgtcaaaaatgataatattttggatgtattgggtgaaataaaatattaacatt

SEQ ID NO: 30880 - DNA, 3710 bp, Homo sapiens
ggagcttggaggagagagcacgaccccctgctgctgccgcaggatgttgcccttgattctaggcagagacaggaggcatcagacagctgtgacagccatggagctcccctaccacttctgagccagagggaagactttggagaagcagaagcccaaagacactgctgggagattggtctgtgctctgggagaaccctaggttgtgtttcccgtgtacaagccaccgatcttgtggaaggtaccaccactcccagccccgcttggctgagggctgcgggccacaggttttcaggaccgtgcttgtggttggaggctgtggactcaagtgcggctggcccgggactttcacagggcgcagggcgggctaggggaaggcccagctgtgaactgataagggggttttacagtctaggccagcacttcttcccctttcacgggcaaacgtgacattctttttcagcacctgtactcacccagctgcatcaaggcggaccagacttgtccaactcacagccccaaaagtcagggcagaataaagcacagtggctgattttagcatttttaaaatagaaatgtgagtcagcacctgatggacctcacagatccctgctatgccacgagggctgctgactggccttaaaagctcagggtggcccggggagctctcagagcaggcctgcttctcacagctgagccgctcagtgctgggggctggtgttgagtgggtgggaaccagccaggttccccgtggagtctgtgcaggaggctctggagggtctggggtagattccctggggagagacttctgtcatttgctttcctccaaggcagcctcagggtctagctggcaagtggtcactttcctgcagaaacatgctatcctcctgttctatcagataaggagggcagaatgaagaggttgggtggaaccctggccttggagtctggagactaggattttactcttgacaaagcacattatatagatagggatattgtcctccaattttcctttcacttccttaattaatattgttatcaatactactgttgatgtattgaactcctgccatcttccaggcactgtgctgaacacttcaccaaacactagagaattaaatcctcacaaccctatgaaagaggtactcttattcctatatgcacatggggaaactgagccttcaggaggttgagaaagttttccaaggtcaccaaacaggatgactttggacccagtctgttaatcatccccctctagagcaccattgatcaaaatggacttgaccatattcctctttggactggttacttagcaaaaaacagaaaaattatttaacaattgtttaaaaccacctctaagtttctctggatatctcattatataagagaggtctcacctctttggctcccacccagctcaactatggaaacacaggctgtaaatttttatagcccaaatcctagtgtccaccactttctgtgctctagtcccactagctgctcttggccctgccactcctggctccccggccttagtgagtttgggaaacatccctccagttcaaccttggcaccttcccttggacacacattaggtattatttctccttcagctgaaggctttgtagctattgaaaggcaaggcatctcttgatgtgagccttgaaggacaggttgctttgggtaggcagagagaagctggtaaggcgtatattgtctaagggtctggaggtggggtataaggggtatacaagtcatagagttggggataggcagaacccagagaggggagaaaactggcctgagatagaagaccttgcaagggagaaggagggtaggagcctggatggtgtgaaatgctagaggtgcatggctggaatggagggggtggggcaccaggcttcagatgcttctgggtgcagatgcagattttcaggatgtacaacatggagcatccccaaggcaactgtgttgagagcctgcgaggcaggtgaatgtggatcttctaccccctctcctgactgagttcaccaaggaacaagctttgtaaactatttgaggctcccaggggctcacccttctttgcatttccagctctcatgaggtcattgtgcacaggaaagctctctcctctaatctcctctgatcctactgcaccagagaaatcaagccagaattcaataaagtctcagtccagataaacaagacaaaagaaataagattcgagtagaagatctccttcaagggaaagttgctgtgtttgtccaagacctttgtcccatccatgtatcatcccccaagtaaacacttcttgttcacctgttcattagatttcaagtgcagtccctggcctgtaagtccctacaatgataagcttctcttatcattgcacattcttcatcaggaggatgccagaggagctcagccaacagttcctcatcagtagcagattcttcagaatcttgggcactacacagatgcccttgagctctttgaataaaggctgatttttagaaaaaacattaagacagaacttaaaaacaatagattgactataatccaaagacgagtgtacctctaaccacaattttcatttatttttaaatgtttccttcatggcctttcttgtggctcaccctatgcagtttgtgtatttgttgacaactttatgtgtttttaatatggtttttgccaaacttggtttttccgagaccgtcttttctcagaggctcagttttaccgtcctatctgcagtcggctactttcagtggcagaagaggccacatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttca

SEQ ID NO: 30881 - DNA, 3149 bp, Homo sapiens
atgttgcccttgattctaggcagagacaggaggcatcagacagctgtgacagccatggagctcccctaccacttctgagccagagggaagactttggagaagcagaagcccaaagacactgctgggagattggtctgtgctctgggagaaccctaggttgtgtttcccgtgtacaagccaccgatcttgtggaagtcggctactttcagtggcagaagaggccacatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctggcagtttgagcagatcctatgtctctgagagacacattcctcataatggccagcattttgggctacaaggttttgtggttgatgatgaggatggcatgactgcagagccatcctcatctcattttttcacgtcattttcagtaactttcactcattcaaaggcaggttataagtaagtcctggtagcagcctctatggggagatttgagagtgactaaatcttggtatctgccctcaagaacttacagttaaatggggagacaatgttgtcatgaaaaggtattatagtaaggagagaaggagacatacacaggccttcaggaagagacgacagtttggggtgaggtagttggcataggcttatctgtgatgaagtggcctgggagcaccaaggggatgttgaggctagtctgggaggagcaggagttttgtctagggaacttgtaggaaattcttggagctgaaagtcccacaaagaaggccctggcaccaagggagtcagcaaacttcagattttattctctgggcaggcatttcaagtttccttttgctgtgacatactcatccattagacagcctgatacaggcctgtagcctcttccggccgtgtgtgctggggaagccccaggaaacgcacatgcccacacagggagccaagtcgtagcatttgggccttgatctaccttttctgcatcaatacactcttgagcctttgaaaaaagaacgtttcccactaaaaagaaaatgtggatttttaaaatagggactcttcctaggggaaaaaggggggctgggagtgatagagggtttaaaaaataaacaccttcaaactaacttcttcgaacccttttattcactccctgacgactttgtgctggggttggggtaactgaaccgcttatttctgtttaattgcattcaggctggatcttagaagacttttatccttccaccatctctctcagaggaatgagcggggaggttggatttactggtgactgattttctttcatgggccaaggaactgaaagagaatgtgaagcaaggttgtgtcttgcgcatggttaaaaataaagcattgtcctgcttcctaagacttagactggggttgacaattgttttagcaacaagacaattcaactatttctcctaggatttttattattattattttttcacttttctaccaaatgggttacataggaagaatgaactgaaatctgtccagagctccaagtcctttggaagaaagattagatgaacgtaaaaatgttgttgtttgctgtggcagtttacagcatttttcttgcaaaattagtgcaaatctgttggaaatagaacacaattcacaaattggaagtgaactaaaatgtaatgacgaaaagggagtagtgttttgatttggaggaggtgtatattcggcagaggttggactgagagttgggtgttatttaacataattatggtaattgggaaacatttataaacactattgggatggtgataaaatacaaaagggcctatagatgttagaaatgggtcaggttactgaaatgggattcaatttgaaaaaaatttttttaaatagaactcactgaactagattctcctctgagaaccagagaagaccatttcatagttggattcctggagacatgcgctatccaccacgtagccactttccacatgtggccatcaaccacttaagatggggttagtttaaatcaagatgtgctgttataattggtataagcataaaatcacactagattctggagatttaatatgaataataagaatactatttcagtagttttggtatattgtgtgtcaaaaatgataatattttggatgtattgggtgaaataaaatattaacatta

SEQ ID NO: 30882 - DNA, 1919 bp, Homo sapiens
aagacaactccttcaccacatttcctgtttgtaactgaaacaaagtacacacaaaagattttaagaaacagaagagaaaagaatccgaggcacagataaagataagttttactgtcatgctgcttttaacataacagagcaacatcacctaggaaaaaagtttgtaggaggatttttaatccatatatttgtcttatggctagataaagatttctctgaaaaaaagaagcatgtcaggaatctctgggtgcccctttttcctctggggacttctagcattgttgggcttggctttggttatatcactgatcttcaatatttcccactatgtggaaaagcaacgacaagataaaatgtacagctactccagtgaccacaccagggttgatgagtattatattgaagacacaccaatttatggtaacttagatgatatgatttcagaaccaatggatgaaaattgctatgaacaaatgaaagcccgaccagagaaatctgtaaataagatgcaggaagccaccccatctgcacaggcaaccaatgaaacacagatgtgctacgcctcacttgatcacagcgttaaggggaagcgtagaaagcccaggaaacagaatactcatttctcagacaaggatggagatgagcaactacatgcaatagatgccagcgtttctaagaccaccttagtagacagtttctccccagaaagccaggcagtagaggaaaacattcatgatgatcccatcagactgtttggattgatccgtgctaagagagaacctataaactagctggaccatgatctagttcaatgatttggctcctattgaagatggcttctaagaaaacaagatgcacagaggacacagaaggacttggcagcagggtgatgacctgatcatttgttgatgggatggtggcttacctcttattcacagcttacacttatgcatgccaaatgtaaggccatgaaaatcagtatttcaaataacttaaaaaatgctttactactaaaatgtaaaaaattaatgtgctcacctcggcagcacatatactaaaaattaataagacccagcttgaaaattgagcctgataacaagattacaaattcacaatacctaatacttagggaaatataaaaatttaagcatgaatgtgttctggaacacgttagaagaaaaataaaagccaatgagtttttttttaattctcctttctcaccaatgggcaatagcccataattgaaataaatttctgattgaaaggtataggaaacattaaaatgcattactaagagaagtaatataattttcttacaaagtatttttcccaaagatagctttactatttcaaaaattgtcaaattaatgcatgctccttacaacaaacaaatatcaaaaagagtttaggaattctactagccagagatagtcacttggagaaactttctatatatccttctaaatatttttctgggcatgcttatgtatgtacatcagttgtttctttttattttgaaccaaaaatgtggtttcttttgtacacattacttaaactttctttccagtcaacaatatattgtggatttattttcactgttatatttaactatatataaatacgcatatattgtaattttaatgtctgcttagcaccccactgataaccaaatcacagtttatttaaataattttaatgacttttcaaaaacaatttattgatgcaaaaagcaaggttgagatgacaatgtttctttcaataattaaaaaatactgcttcactgtcttctctctgtttcatcagaaacacatactataatacttgtctctgtccttaagtgtgatacacgctatttttctgattgttaagactttccttattactggttctaatttgattataatatgccaaggtatggt

SEQ ID NO: 30883 - DNA, 2436 bp, Homo sapiens
tttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactgcggcgagacgagcgcggcgcatcccaaagcccggccaaatgcgctcgtccctgggaggggagggaggcgcgcctggagcggggacagtcttggtccgcgccctcctcccgggtctgtgccgggacccgggacccgggagccgtcgcaggtctcggtccaaggggccccttttctcggaagggcggcggccaagagcagggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttgggggtccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatgggggtggcttcttcctggaaccagcaccctgtgtccacctgcaaatcctcatcctcagtttggaggtgccctctccctcccctccacgcacagctgtgacaggtacccaaccctgaggagccaccggtcctcaccctaccccagcccctatgctcatcggaacaattctccaacctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagcggtgctgtcccaggtggcttacagatgaacccaactgtggagatgatgcagttggcccaacctcactgacggtgaaaaaatgtttgccagggtccagaaactttttttggtttatttctcatacagtgtattggcaactttggcacaccagaatttgtaaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcaaaataaacgcaatatgcaaaa

SEQ ID NO: 30884 - DNA, 902 bp, Homo sapiens
gaggaggacacttctcagaaggggttgttttgcttttgcttatttccgtccatttccctctctgcgcgcggaccttccttttccagatgggcggcggccaagagcagggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttgggggtccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaa

SEQ ID NO: 30885 - DNA, 1120 bp, Homo sapiens
agatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagactctcctacggatgtgaatcaagagaacgtccccagctttggcatcctcaagtatcccccgagagcagaatagggtattaaagctcatagatttgccctgaaatacactgccaatgcccagcacactgtcggccaaacacaaagacacttagaggcacgtgtgtttgtacacatcccccgtctttcatctctttcctctggatcatggacggcagctgactattgagcaggactctttcagagggacccataattgcagctttcataatcttaccattgagggagcattcccaacctgttaggtgtcaggcagaataggacataaggtttctgggagctggcatttaaagattagatgagatggatcaacacagatcattgtgtcatctgatttcattcatgtgaaacttactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttt

SEQ ID NO: 30886 - DNA, 588 bp, Homo sapiens
aggttctcagtgaggttcaaggagaacagtgtggctgtcaaggtcgtccagggccctgcaggtggtgacaacagcaagctacgctacaaaaaaaaggggagtcattgcttggaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagactctcctacggatgtgaatcaagagaacgtccccagctttggcatcctcaagtatcccccgagagcagaatagg

SEQ ID NO: 30887 - DNA, 731 bp, Homo sapiens
agatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacactctcctacggatgtgaatcaagagaacgtccccagctttggcatcctcaagtatcccccgagagcagaataggtactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttt

SEQ ID NO: 30888 - DNA, 816 bp, Homo sapiens
ctgagtgactgcagccttcctagatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagactctcctacggatgtgaatcaagagaacgtccccagctttggcatcctcaagtatcccccgagagcagaataggtactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttttgcatatgaa

SEQ ID NO: 30889 - DNA, 2318 bp, Homo sapiens
acggcaagtagcaagcagcaaaaggcgtggtagctgcggcggtggaatgagacagttgtcaacagctggcgcagctgccgcgctgcgcaccgggactggcgagtacgcagcccaggtactgccccttcccagtgacgtctctgcagggggttataaaagcctcgtgcgcagctaactcgcgagctgagcaacccgaaccgagaggtgcccgcgaaactgcaggcggcggcagcggcagcaaaagagaaggaaaaatctccagctggatacgaagctccagaatcctggccataggctcagaacttttacaggtcgcgctgcaatgggcccccacttcgctcctaagtcctcacgcagcacagggctttgcctttccctgcggaggaaggagaaataggagttgcaggcagcagcaggtgcataaatgcgggggatctcttgcttcctagaactgtgaccggtggaatttctttccctttttcagtttaccgcaagagagatgctgtctccagacttctgaactcaaacgtctcctgaagcttgaaagtggaggaattcagagccaccgcgggcaggcgggcagtgcatccagaagcgtttatattctgagcgccagttcagctttcaaaaagagtgctgcccagaaaaagccttccaccctcctgtctggctttagaaggaccctgagccccaggcgccagccacaggactctgctgcagaggggggttgtgtacagatagtagggctttaccgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttctttcccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctaggccacagggcctttggcaggtgcagcccccactgcctttgacctgcctcccttcatgcatggaaattcccttcatctggaaccatcagaaacaccctcacactgggacttgcaaaaagggtcagtatgggttagggaaaacattccatccttgagtcaaaaaatctcaattcttccctatctttgccaccctcatgctgtgtgactcaaaccaaatcactgaactttgctgagcctgtaaaataaaaggtcggaccagcttttcccaaaagcccattcattccattctggaagtgactttggctgcatgcgagtgctcatttcaggat

SEQ ID NO: 30890 - DNA, 1270 bp, Homo sapiens
gaaaaagccttccaccctcctgtctggctttagaaggaccctgagccccaggcgccagccacaggactctgctgcagaggggggttgtgtacagatagtagggctttaccgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttctttcccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggtgaggatcccaaccccatgagctctccaggggccacaagaccatctacatacacagtggccaagcggccatcctaaatgagtaaacccagctgtgagacaagagggacaagtggggactgcagctaacttatcatcacacaactcagcctggctgattatcaccatccaggaatgggagcccggagtggactgattttctttttttcttttcca

SEQ ID NO: 30891 - DNA, 2083 bp, Homo sapiens
gcacccagcacccagcccggcttgcagcccaaagcctggagagaggctgctgcgccattgacctgtggactccagagactcccgctgtgcattcctctgatctggaaggtttcctgaattacgtgacgagaaacctgggttcgagtcctaacttgtcaccaacttcctgagtgacctgggctggtcccgtcccctcttggaatctctgtcttccatctcttcagcgaaggggttgatttataagggtgttttctgctctgacactgtgatttgaattctgtgtttccacatgatattcgagaagtctggccggaaggatggaatctgaaatgacaatggttctggactgggctttgtgctcagcccagctcatctttgcctgagacctaggagtggccccaggctctcctgatgtgccaccacgcttggcatctgctcctctccctgcccccatattcccatgctctgaaggggagttctctttcatagcaaatccgagaggagccgaggagccaggtcctttgttccagacccagaagcagccatggggacctgtgacattgtgactgaagccaatatctcatctggccctgagagcaacaccacgggcatcacagccttctccatgcccagctggcaactggcactgtgggccacagcctacctggccctggtgctggtggccgtgacgggtaatgccatcgtcatctggatcatcctggcccatcggaggatgcgcacagtcaccaactacttcatcgtcaatctggcgctggctgacctctgcatggctgccttcaatgccgccttcaactttgtctatgccagccacaacatctggtactttggccgtgccttctgctacttccagaacctcttccccatcacagccatgtttgtcagcatctactccatgaccgccattgctgccgacaggtacatggccatcgtccaccccttccagcctcggctttcagctcccagcaccaaggcggttattgctggcatctggctggtggctctcgccctggcctcccctcagtgcttctactccaccgtcaccatggaccagggtgccaccaagtgcgtggtggcctggcccgaagacagcgggggcaagacgctcctcctgtaccacctcgtggtgatcgccctcatctacttcctgccgctcgcggtgatgtttgtagcctacagcgtcatcggcctcacgctctggaggcgcgcagtgcccggacatcaggcgcacggtgccaacctgcgccacctgcaggccatgaagaagtttgtgaagaccatggtgctggtggtgctgacgtttgccatctgctggctgccctaccacctctacttcatcctgggcagcttccaggaggacatctactgccacaagttcatccagcaagtctacctggcactcttctggttggccatgagctctaccatgtacaatcccatcatctactgctgtctcaaccacaggtttcgctctggattccggcttgccttccgctgctgcccatgggtcacacccaccaaggaagataagctcgagctgactcccacgacctccctctccacgagagtcaacaggtgtcacactaaggagactttgttcatggctggggacacagccccctccgaggctaccagtggggaggcggggcgtccccaggatggatcagggctatggtttgggtatggtttgcttgcccccaccaaaactcatgttgaaatttgatcccaatgtggcagtgttgggaggtaggggttagtgggaggtgtttgggtattggggatggatcccttatgaatagattaatgccttccagttgaagtgaatcatcactcttgtgggaatggactagttcccaaaataacaagttgttagaaagagtgtggtgtcctcagtttccctgtcttgcttcctctctcaccatgtgatctctttgcacacaacacttcccttccactttccaccatgacaagaagcagcctgaggccttcaccagatgcagctgcccaatcttggatattccagccaccagaatcatgagccaaataaacctcttttctttataaa

SEQ ID NO: 30892 - DNA, 1740 bp, Homo sapiens
ccttttgcagggaagccgtctcctggcacacaggctacccaatgccacctttatttttgtttaaatcaaaccaagtccctgggaggcgcccagggtgggcccgcaggggcggctccacagtgcccgcggggtcccaggaccaggcgctggcagacttcggagtcgcccccgggccctccgctgcccaggcctcggctctccctgcaggtaccacctcgtggtgatcgccctcatctacttcctgccgctcgcggtgatgtttgtagcctacagcgtcatcggcctcacgctctggaggcgcgcagtgcccggacatcaggcgcacggtgccaacctgcgccacctgcaggccatgaagaagtttgtgaagaccatggtgctggtggtgctgacgtttgccatctgctggctgccctaccacctctacttcatcctgggcagcttccaggaggacatctactgccacaagttcatccagcaagtctacctggcactcttctggttggccatgagctctaccatgtacaatcccatcatctactgctgtctcaaccacaggtttcgctctggattccggcttgccttccgctgctgcccatgggtcacacccaccaaggaagataagctcgagctgactcccacgacctccctctccacgagagtcaacaggtgtcacactaaggagactttgttcatggctggggacacagccccctccgaggctaccagtggggaggcggggcgtccccaggatggatcagggctatggtttgggtatggtttgcttgcccccaccaaaactcatgttgaaatttgatcccaatgtggcagtgttgggaggtaggggttagtgggaggtgtttgggtattggggatggatcccttatgaatagattaatgccttccagttgaagtgaatcatcactcttgtgggaatggactagttcccaaaataacaagttgttagaaagagtgtggtgtcctcagtttccctgtcttgcttcctctctcaccatgtgatctctttgcacacaacacttcccttccactttccaccatgacaagaagcagcctgaggccttcaccagatgcagctgcccaatcttggatattccagccaccagaatcatgagccaaataaacctcttttctttataaattacctagtctcaggtattccatgaaagcaacacaaatggactgagataggtgcctattgaaccctgaagccttgtgcctggctgcagaatgaggtgtagcaccctttgagaagtagccaatcgagaagaccacatctgaaagttcagctcatgccccatccttcagtataccaatacaaagacaacatggggccagaactccagaaaggatgctgactttaagaggactcagccacccatctcagagagcacttcagaggatccagtaagggtcagaaaagacagtgtaagctgatatttatctaatttaagagatgcaagctcaaatgccttcctggggcatacaagaatatgtataaaagaaaaactgcaaatgtgatgataaaaggcaactgacttccaccctcagtttgagctaatagggaatggtgggggccatggcaacctggagaggacaggcattcaaaggggacaagaactactcagctctggacaaacgttgccacatgataatgggagcccactgttgctagatcttctaaatctttcaagagaagctataaatccacatttgtatgtg

SEQ ID NO: 30893 - DNA, 5190 bp, Homo sapiens
attgcagtatctttcagcttccagtcttatctgaagactccggcaccaaagtgaccaggaggcagagaagaacttcagaggagtctcgtcttgggctgcccgtgggtgagtgggagggtccgggactgcagaccggtggcgatggccactctcccagcagcagaaacctggatagacgggggtggaggcgtgggtgcagacgccgtgaacctgaccgcctcgctagctgccggggcggccacgggggcagttgagactgggtggctgcaactgctggaccaagctggcaacctctcctcctccccttccgcgctgggactgcctgtggcttcccccgcgccctcccagccctgggccaacctcaccaaccagttcgtgcagccgtcctggcgcatcgcgctctggtccctggcgtatggtgtggtggtggcagtggcagttttgggaaatctcatcgtcatctggatcatcctggcccacaagcgcatgaggactgtcaccaactacttccttgtgaacctggctttctccgacgcctccatggccgccttcaacacgttggtcaatttcatctacgcgcttcatagcgagtggtactttggcgccaactactgccgcttccagaacttctttcctatcacagctgtgttcgccagcatctactccatgacggccattgcggtggacaggtatatggctattattgatcccttgaaacccagactgtctgctacagcaaccaagattgtcattggaagtatttggattctagcatttctacttgccttccctcagtgtctttattccaaaaccaaagtcatgccaggccgtactctctgctttgtgcaatggccagaaggtcccaaacaacatttcacttaccatattatcgtcattatactggtgtactgtttcccattgctcatcatgggtattacatacaccattgttggaattactctctggggaggagaaatcccaggagatacctgtgacaagtatcatgagcagctaaaggccaaaagaaaggttgtcaaaatgatgattattgttgtcatgacatttgctatctgctggctgccctatcatatttacttcattctcactgcaatctatcaacaactaaatagatggaaatacatccagcaggtctacctggctagcttttggctggcaatgagctcaaccatgtacaatcccatcatctactgctgtctgaataaaagatttcgagctggcttcaagagagcatttcgctggtgtcctttcatcaaagtttccagctatgatgagctagagctcaagaccaccaggtttcatccaaaccggcaaagcagtatgtacaccgtgaccagaatggagtccatgacagtcgtgtttgaccccaacgatgcagacaccaccaggtccagtcggaagaaaagagcaacgccaagagacccaagtttcaatggctgctctcgcaggaattccaaatctgcctccgccacttcaagtttcataagctcaccctatacctctgtggatgaatattcttaattccatttcctgaggtaaaagattagtgtgagaccatcatggtgccagtctaggaccccattctcctatttaccagtcctgtcctatataccctctagaaacagaaagcaatttttaggcagctatggtcaaattgagaaaggtagtgtataaatgtgacaaagacactaataacatgttagcctccacccaaaataaaatgggctttaaatttattctttgaaaactctaaattattatatgcaatgaacaaaaatatgtcaggaaaatacttgtaaactcgccagtctatctcatttacaaattgcaatatacatttgtgacattaaaatgatatatagtttttccaagagattaaagaatctttaaaacataatattgtaagtgaagggaaacaaaatctgtataaaatctgtataaaataggcttttttgcctagagatataaaatgggaaaaaaagttaaatgattcattttcccactagagtaatggaaaattaacctcaagaagtaggaactgaaaatctttgctcaagaaaactcattttgtagaatgtaaagatttaaagatttaaagatttcttccatggcatttaactgaaaaggaaatctagttaaatcattaggcaaatgtatatttcattctcttgattttttttctgagaaagtgaaattttaaaaaattatatactttttgaccattacttatttttgaataccaagctaaaaagtagtcagttaagaccctaaaaatatgaagaaaattcctatcattttttatttttcacagattttttaaatagctagattataaaacagtaaaggtacattccaataaatagaggaagaatactatttatgttctcttcctctcccctcactgaaaatagaataaggactaggagaaaatatcttcaaaggcaactccttagggaaaaaaagtcacaagtgtgacaaaagactatatggttgaaaaataccaatatatgttacatatgagtaaactaggcaaggtgtagacaagtgaattacctcttagaaaacgaatctgcacaatagtttggatacatgtaaactaataacagctgagcaagagggtgagtttaacacacatccttccacagaaagaccttttctttcatttgcttagattattcagaagtcttaccagaaagaaatgagataatagtcctaagaaagcatcacatttactacaagaagatatatactagcacatttctgagactcataacataacaagaaatacttttaagtgtaaaaagtaacatccaggcctcagtgcttacagatcatctttccttgaattagggatactgttaatcctgctcaagaaagcagaaactttttgagaatgtgaatgtgtagtacaaacttctcctttaaactcttcagtttgatttttaaagatatttgtctaaaataatactctctaacaaacactttactgttgtgcctccaccgatattaaaacaaaatatttttgaagaacagaataaaagcaaatattcaatggcaaatcatggtctatttctcaaatctcttccctattttgaagccaaaaccagaaatatccaattgttacaaaaagttcggagtctaaacaagctaaacatatgtgttccagctgaatttcttctgatgataccaataaacaaagagacacacacacacacacacacacatacaaatgtgcctacacattcaatcatttaatgaatgcaacaacttcaaagaattaaaatcaaatactgaaatgataagtggtcattacagcattgccatatgctcaataaagtctgtgaagcttgtgtgcatgttttaaataagcaaatttaatatatagtatctaattgtttgaatataatgtttttgaatgttcattcttaaaacatatatttatcatacaatgttaaagtgtcaagaaaaagcctaatatgtaaaaagttattattttcttaaatttatgaatgatatggtactagcattaattaatgttttagacatatggaaccatattcagctgtaaaatatgaatatgaagtttagccctcaaatttaatgtcatcagccactaccaaagtatcatacatttgaaaaatataactcctggccctcacatattagagaaattcagtagaattttctaagacatttatttctaaggaaaaatactggcctcgtcagttggattgttggtttgctttggcttctgtgaacatacatattgttgtgttgcttaccgagcacctcccttctagtgtgacagaaatacccagacagtattttttcaatgctttccagaaaaaaactggcatcattcactcactactcatggcccttaaactgagacctataggcagaattttttaagttcaaaaatttaaacgacaataataaaacaagagtgaaatataaaagagaagatttttcactcttttgtctgcattttgacaataagaattacagaataatgcacaaaatcaaattcagtgagattcatttttaaataaagtcatcccagtgttttcatatttgctaagcttggaaagaatctgccttcaaaatttactctaccctctgtttctaaagttcagtatgaatctttccattgtttgaaggcaaacactggctcagactactaggcagatggttaaaacagcccaggtttttttacttagatcagtatcagaaaaattcaaaatatttttaaacaaatatgaaagaatcaaaaaggcttacatcattgtaagtattctcttttaaacaaaatacattaaatcaaaaataaacattgcttactattttgcatctggacaaagtacaagatattgaaattacctgtatgggaaaatattaaagcggacataattgttacagaattcactctcacacttttttattttttaccaagtacagcacactgttgcattattccatcttctaacttcatgatggtgacatttctgacccagcagctgaattcatgtccttttccaaatcctgccaatgtcttagaaacagtgaactgagcaatttcagagtgaaccccgcccttacaaagcacataaagaataccaagaagcttggtatcaagcctatgaaatacaaaataaatgtgaaaaataaatgctggccagctcaacatttgaatttagtttttgcaaatgcaaaatttcctctaaaaatttatgattagtacctggtaaactatttcatcaaatagaaaagcaggagacttacaaacatttctcacacttctaacagtaacaatttcctacttatcattgataatatgtcaaaagctaaggaaatccagaatgacatggaccatgtagaacaataaggttggaataatttcccttagggccaagcaggaatagagaataaagttcagaagggctgtacaaggtcattagttttgtgttttcatacatatatatatatatatgaaaaatctgtttatataagaagtaaatgtatataaagtttgtagtgaataaagtattttcaagttgtggtaattatattgaatatgtttaatgtatttacaccctttgcatatgtgataatgtgacagatttaatttctattttttctttaaaaacattaaaactaatattaaaagtaaaa

SEQ ID NO: 30894 - DNA, 5692 bp, Homo sapiens
tttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaaatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcagcctcctgatttgtatgataccaacacatccctcagtatgtctcgagatgcctctgtatttcaagatgagagcaatatgtctgtcttggatattcccagtgccactccagaaaagcaggtaacacaggaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcagttatgggagctatgaggagcctgatcccaagtcgaacacccaagacacaagcttcagcagcatcggtgggtatgaggtatcagaggaggaagaagatgaggaggaggaagagcagcgctctgggccgagcgtactaagccaggtccacctgtcagaggacgaggaggacagtgaggatttccactccattgctggggacagtgacttggactctgatgaatga

SEQ ID NO: 30895 - DNA, 7629 bp, Homo sapiens
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaaatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcagcctcctgatttgtatgataccaacacatccctcagtatgtctcgagatgcctctgtatttcaagatgagagcaatatgtctgtcttggatattcccagtgccactccagaaaagcaggtaacacaggaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcagttatgggagctatgaggagcctgatcccaagtcgaacacccaagacacaagcttcagcagcatcggtgggtatgaggtatcagaggaggaagaagatgaggaggaggaagagcagcgctctgggccgagcgtactaagccaggtccacctgtcagaggacgaggaggacagtgaggatttccactccattgctggggacagtgacttggactctgatgaatgaggcttcctttgggcctccttggtcagccttccctgttctccagcctaggtggttcacctttccccaatttgttcatatttgtacagtatctgatcctgaaatcatgaaattaactaacaccttagcctttttaaaagtagtaagtaaatgataataaatcacctctcctaatcttcctggggcaatgtcaccctttgatttaaaacaaagcaaccccctttcccctaccactacggaaaagagcaagctcatttttccgtgtcctcctttatttaactccatttattgcttttggtataatttttccctggggaaggaggggaaattatgaaagaactagtaactttatgtcctcttgatgtattaggaaatttccggccaggcgtggtggctcacacctgtaatctcagcactctgggaggccgaggcgggcagatcacctgaggtcagaagttcgagaccagcttggccaacatggcgaaaccgcatctctactaaaaatacaaaaattagccaggtgtggtggcgtatgcctgttaatcctagctactcgggaggctgaggcaggagaattacttgaacccgggaggcagaggttgcagtgagtggaggtcacgccactgcactccagcctgggcgaaagagtgagattcagtctcaaaaaaaaaaaaatttccaagcatggtatcatctcacttttctaatttacaggctggagcagatgagagccctcctgctgggacagagaattgggttctagtggactctgtgctacacttaaacctgtgagacaaaccgcccattattttattatttaattatgcaatgcctagttcctaaatggattggaggcaaattaccgtaaattttgaaacagcctatatgtcagaaatgataatgttgccacctaaatgttttctgtcccccccaccctccccaggggaaatggtaggaaaatggtaagtttcttagggcaaagactgtgtcttctgtttcttttcatgcttaggatatggttctgtgcatagtaggtactcagtaaatgttcctagaatcataaaatcctcaacagatatgttactgagcatctgcttttcatgataagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaaccatgtgtgtttatatgtgtttatatatatacttgtgtatgcaaaggtaaaagtctgaaaggatatatgctaactgttcacaatgataaccccccaggaatgggattggaggggagggggcttctgtgtttgttatgtatgctgggtgggatattgtgcttttatttctatattgtttgaatttttttacagtatgtattatttttgtaataaaaattttaaaaaattcca

SEQ ID NO: 30896 - DNA, 5625 bp, Homo sapiens
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaaatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcaggctaagcctcctgatttgtatgataccaacacatccctcagtatgtctcgagatgcctctgtatttcaagatgagagcaatatgtctgtcttggatattcccagtgccactccagaaaagcaggtaacacagatgcgccagggccgaggtaggctgggcgaggaagactctgatgtagatattgaagggtatgatgatgaggaggaggatgggaaacctaagactccagccccagaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcagccatcaa

SEQ ID NO: 30897 - DNA, 7675 bp, Homo sapiens
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaaatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcaggctaagcctcctgatttgtatgataccaacacatccctcagtatgtctcgagatgcctctgtatttcaagatgagagcaatatgtctgtcttggatattcccagtgccactccagaaaagcaggtaacacaggaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcagttatgggagctatgaggagcctgatcccaagtcgaacacccaagacacaagcttcagcagcatcggtgggtatgaggtatcagaggaggaagaagatgaggaggaggaagagcagcgctctgggccgagcgtactaagccaggtccacctgtcagaggacgaggaggacagtgaggatttccactccattgctggggacagtgacttggactctgatgaatgaggcttcctttgggcctccttggtcagccttccctgttctccagcctaggtggttcacctttccccaatttgttcatatttgtacagtatctgatcctgaaatcatgaaattaactaacaccttagcctttttaaaagtagtaagtaaatgataataaatcacctctcctaatcttcctggggcaatgtcaccctttgatttaaaacaaagcaaccccctttcccctaccactacggaaaagagcaagctcatttttccgtgtcctcctttatttaactccatttattgcttttggtataatttttccctggggaaggaggggaaattatgaaagaactagtaactttatgtcctcttgatgtattaggaaatttccggccaggcgtggtggctcacacctgtaatctcagcactctgggaggccgaggcgggcagatcacctgaggtcagaagttcgagaccagcttggccaacatggcgaaaccgcatctctactaaaaatacaaaaattagccaggtgtggtggcgtatgcctgttaatcctagctactcgggaggctgaggcaggagaattacttgaacccgggaggcagaggttgcagtgagtggaggtcacgccactgcactccagcctgggcgaaagagtgagattcagtctcaaaaaaaaaaaaatttccaagcatggtatcatctcacttttctaatttacaggctggagcagatgagagccctcctgctgggacagagaattgggttctagtggactctgtgctacacttaaacctgtgagacaaaccgcccattattttattatttaattatgcaatgcctagttcctaaatggattggaggcaaattaccgtaaattttgaaacagcctatatgtcagaaatgataatgttgccacctaaatgttttctgtcccccccaccctccccaggggaaatggtaggaaaatggtaagtttcttagggcaaagactgtgtcttctgtttcttttcatgcttaggatatggttctgtgcatagtaggtactcagtaaatgttcctagaatcataaaatcctcaacagatatgttactgagcatctgcttttcatgataagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaaccatgtgtgtttatatgtgtttatatatatacttgtgtatgcaaaggtaaaagtctgaaaggatatatgctaactgttcacaatgataaccccccaggaatgggattggaggggagggggcttctgtgtttgttatgtatgctgggtgggatattgtgcttttatttctatattgtttgaatttttttacagtatgtattatttttgt

SEQ ID NO: 30898 - DNA, 7708 bp, Homo sapiens
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaaatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcagcctcctgatttgtatgataccaacacatccctcagtatgtctcgagatgcctctgtatttcaagatgagagcaatatgtctgtcttggatattcccagtgccactccagaaaagcaggtaacacagatgcgccagggccgaggtaggctgggcgaggaagactctgatgtagatattgaagggtatgatgatgaggaggaggatgggaaacctaagactccagccccagaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcagttatgggagctatgaggagcctgatcccaagtcgaacacccaagacacaagcttcagcagcatcggtgggtatgaggtatcagaggaggaagaagatgaggaggaggaagagcagcgctctgggccgagcgtactaagccaggtccacctgtcagaggacgaggaggacagtgaggatttccactccattgctggggacagtgacttggactctgatgaatgaggcttcctttgggcctccttggtcagccttccctgttctccagcctaggtggttcacctttccccaatttgttcatatttgtacagtatctgatcctgaaatcatgaaattaactaacaccttagcctttttaaaagtagtaagtaaatgataataaatcacctctcctaatcttcctggggcaatgtcaccctttgatttaaaacaaagcaaccccctttcccctaccactacggaaaagagcaagctcatttttccgtgtcctcctttatttaactccatttattgcttttggtataatttttccctggggaaggaggggaaattatgaaagaactagtaactttatgtcctcttgatgtattaggaaatttccggccaggcgtggtggctcacacctgtaatctcagcactctgggaggccgaggcgggcagatcacctgaggtcagaagttcgagaccagcttggccaacatggcgaaaccgcatctctactaaaaatacaaaaattagccaggtgtggtggcgtatgcctgttaatcctagctactcgggaggctgaggcaggagaattacttgaacccgggaggcagaggttgcagtgagtggaggtcacgccactgcactccagcctgggcgaaagagtgagattcagtctcaaaaaaaaaaaaatttccaagcatggtatcatctcacttttctaatttacaggctggagcagatgagagccctcctgctgggacagagaattgggttctagtggactctgtgctacacttaaacctgtgagacaaaccgcccattattttattatttaattatgcaatgcctagttcctaaatggattggaggcaaattaccgtaaattttgaaacagcctatatgtcagaaatgataatgttgccacctaaatgttttctgtcccccccaccctccccaggggaaatggtaggaaaatggtaagtttcttagggcaaagactgtgtcttctgtttcttttcatgcttaggatatggttctgtgcatagtaggtactcagtaaatgttcctagaatcataaaatcctcaacagatatgttactgagcatctgcttttcatgataagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaaccatgtgtgtttatatgtgtttatatatatacttgtgtatgcaaaggtaaaagtctgaaaggatatatgctaactgttcacaatgataaccccccaggaatgggattggaggggagggggcttctgtgtttgttatgtatgctgggtgggatattgtgcttttatttctatattgtttgaatttttttacagtatgtattatttttgt

SEQ ID NO: 30899 - DNA, 4827 bp, Homo sapiens
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaaatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatgggtacatgtgcacaacgtgcaggttt

SEQ ID NO: 30900 - DNA, 1215 bp, Homo sapiens
ccccacctctcggggcagctggcggagaagagagggggctttccaaatccactatgaatccttaaaaggctgaataagggaacttgaaacgatgcagacaggcaggcaacccgtagtcgagggacatagggccataaacgtcgaagccaggtcttgagcgtcagacagaatgaggtgtcccagagcggcggaggagagccagacgcacgctggttccggtctggacggaatcgccgcggagcacggcagaggctagggcggaatggctacggcagcgcagttcgccaaggctcggtctccgccctgcagcctatttcctctaacccgcagatccactatgggaggaggcggggagcgggctggagagcactaacagagacaggcggggcgagtcgtgggcgcgtgacgtcaccccggggtgtgcgcggcgcgagcggaagcggaagcggctctgttcgccgcctctcccaccggcccgatgagctgcagcggctccggcgcggaccccgaggcggcgccggcctccgccgcctcggccccgggccccgcgcccccggtctcggctcccgccgcgctgccctccagcaccgccgcggagaacaaggccagccccgcggggacagcggggggacctggggctggagcagctgctgggggcacgggacccttggcggcgcgggccggggagccagctgagcggcgtggggcggctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacgatcccagatgcagtgactggttactacctgaaccgtgctggctttgaggcctcagacccacgcataattcggctcatctccttagctgcccagaaattcatctcagatattgccaatgatgccctacagcactgcaaaatgaagggcacggcctccggcagctcccggagcaagagcaaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgacaggc

SEQ ID NO: 30901 - DNA, 1580 bp, Homo sapiens
caggagagcggtaggggtgatgtcatcgctgcgcgacgacaggaagtaagatcctggcctgtgcagctcgggtttccgagcttctgcctcaggcatctccgcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggacttgaaagaagctgcagcggaggaaggcgagctcgagagtcaggatgtctcagatttaacaacagttgaaagggaagactcatcattacttaatcctgcagccaaaaaactgaaaatagataccaaagaaaagaaagagaaaaagcagaaagtagatgaagatgagattcagaagatgcaaatcctggtttcttctttttctgaggagcagctgaaccgttatgaaatgtatcgccgctcagctttccctaaggcagccatcaaaaggctgatccagtccatcactggcacctctgtgtctcagaatgttgttattgctatgtctggtatttccaaggttttcgtcggggaggtggtagaagaagcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtgatactctaccatgaaggatgcggtaatggcaggaatagcagaataattggtgcttgtaaacatttaagattctcctgtggattttggtgagtgatcattaaactgttttccaacttgc

SEQ ID NO: 30902 - DNA, 1241 bp, Homo sapiens
aagatcctggcctgtgcagctcgggtttccgagcttctgcctcaggcatctccgcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggacttgaaagaagctgcagcggaggaaggcgagctcgagagtcaggatgtctcagatttaacaacagttgaaagggaagactcatcattacttaatcctgcagccaaaaaactgaaaatagataccaaagaaaagaaagagaaaaagcagaaagtagatgaagatgagattcagaagatgcaaatcctggtttcttctttttctgaggagcagctgaaccgttatgaaatgtatcgccgctcagctttccctaaggcagccatcaaaaggcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaag

SEQ ID NO: 30903 - DNA, 1359 bp, Homo sapiens
agacgctgctgcctgtgagtcttgggccctggcagttgaggaacaagagcgggaggagggagtcaggacccagacctacagtgggtcagtgttcgaaggaccaggttgtggacgagacggggctgtgaggattcaggctcttgggaagggactgactgagaggatcaggctcggagaagacgcggctgtggggacccgggctctaagacgggacttagggaacggggacggatgcgagttctccggcatctgagggaaagtggtctgagaggagcaggattatgaggacccgcactcctacgaggaaagggtcagaaaggaacggggcgtgaagacacaggctccggagagttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggctctgaagaaatccgaccctacaaaaaagcttgcaccacagaagctcacaaacagagaatggcattgatccggaaaacaaccaagaaataacacacggaaaggtcagggaatggacagcaatgtatttggagatacttgagctgagaactcagccatctcatccttggatttttttttttaatgctttacagagaagcatatattttttattaacagtgcagcaatatctataatgactgagaggatctgccaaaagaataaagcctcctaccccaacttccggtcccttttccctgccatctcaaagaggagcaatgtatcttccagagaagattttatttgtggtttattatataagtgactgaatatgggacaaagcattatggtctttttgggtaagacagtattagcaggatttgtaaagggttttgtttccttctcccttccccttttccctgtactttgtaatgtcagtgtttatatgaatatgactttcatttgcttttccagaataaagaagttattaat

SEQ ID NO: 30904 - DNA, 1334 bp, Homo sapiens
gtcggaccggctgctgagacgaacgcttcactggggcagtctctgcatatcatggggagatagacgctgctgcctttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggctctgaagaaatccgaccctacaaaaaagcttgcaccacagaagctcacaaacagagaatggcattgatccggaaaacaaccaagaaataacacacggaaaggtcagggaatggacagcaatgtatttggagatacttgagctgagaactcagccatctcatccttggatttttttttttaatgctttacagagaagcatatattttttattaacagtgcagcaatatctataatgactgagaggatctgccaaaagaataaagcctcctaccccaacttccggtcccttttccctgccatctcaaagaggagcaatgtatcttccagagaagattttatttgtggtttattatataagtgactgaatatgggacaaagcattatggtctttttgggtaagacagtattagcaggatttgtaaagggttttgtttccttctcccttccccttttccctgtactttgtaatgtcagtgtttatatgaatatgactttcatttgcttttccagaataaagaagttattaatcgaaagacagggtacctttgaaatcccagagggagtcaggacaagcaagcctggattgtagctctctagtcagcaggtggcagcatcgttattcattttggtgtttgagaaaaactcagggattttccatcattttaccccaagggaggccataacatcagcaggagtttgagtccagcttctcggccataagaattgagtagggtgaccttctctcacggccctcaactgaagaggcatccttgttttgg

SEQ ID NO: 30905 - DNA, 2191 bp, Homo sapiens
agtccgcctcagcccgccgcgccgccctcagtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggacttttgta

SEQ ID NO: 30906 - DNA, 2153 bp, Homo sapiens
agtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtgg

SEQ ID NO: 30907 - DNA, 1879 bp, Homo sapiens
agtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttctt

SEQ ID NO: 30908 - DNA, 4872 bp, Homo sapiens
cagcgggaggcggagcgagtccaaaatggcggctctcaggctggcgcgctccgtgctgctggggctttgaggtggtcgccgggggtccgggggaccctttccccgccgcggaagccctagaggatgaatcggggaccctgctaaggtctggcggcggggctggagagcagtggcagcaagggctgcggtggcgtccacgcagcgggatgtgcgagagttactccaggtcgttgttgagggtctcggtggcgcagatctgccaggcgctgggctgggactcggtgcagctcagcgcctgccacctcctcacggacgtgctgcagcgctatctgcagcagctgggccggggctgccatcggtactctgagctctatggccgaacagacccaattttggatgatgttggtgaagctttccagctgatgggggttagtctacatgaactagaagactatattcacaacattgagcctgtcaccttcccacaccaaattccgtcatttcctgttagcaagaacaatgtacttcagtttcctcaacctggaagtaaagatgcagaggaaagaaaagaatacattcctgattacctgccacccattgtgtcttctcaagaagaagaagaagaagagcaggtgcccactgatggaggcacatcagcagaagccatgcaggttcccttggaagaagatgatgaattggaggaggaagaaattattaatgatgagaatttcctgggcaagagaccactggatagtcctgaagctgaagaactgccagccatgaagcggcctcggctattaagcactaaaggggacacgctagatgttgtgttattggaagctcgagagccactcagctcaataaatactcaaaagatcccaccaatgctttctccagtccatgtacaggacagtacagacttggcacctccctcacccgagccgccaatgttggctccagttgcaaaatcacaaatgccaactgcaaaaccattagaaacaaagtcatttacacctaaaacaaagactaaaactagctctccaggacagaagactaaatcacctaaaaccgcccagtcaccagcaatggtcggaagtcctattcgatcaccaaaaactgtatccaaagaaaagaaatcacctggacgttccaagagccccaagagtcccaagagccccaaggtcacgactcacattccccaaacacctgtgagacctgaaacgcccaacaggactccttcagctacactcagtgaaaaaatcagtaaagagactatccaggtaaaacaaatacagacaccccctgatgctgggaaactgaacagtgagaatcagccgaaaaaggctgtggtagcagataaaacgattgaggcctctatcgatgctgtgattgcacgagcctgtgctgagcgagagccagatcctttcgaattttcttctggatcggaatctgaaggagacatttttactagccctaagagaatttcaggcccggagtgtactactcccaaagcttccacttccgcgaacaatttcacaaagtcaggatccactcctctgcctctttccggtggaacctcaagttccgataactcatggacaatggatgcctccattgatgaggttgtacgtaaagcaaaactgggaacaccttcaaatatgccccccaactttccttatatctcttctccgtcagtgtctcctcccactcccgaacctctccacaaggtgtatgaggagaaaaccaagctgccttcctccgtggaggtaaagaagaagttgaaaaaggaactaaagactaaaatgaaaaagaaagaaaagcagagagatagggagagggaaaaagacaagaacaaggacaaaagtaaggagaaggataaagtgaaagagaaagagaaagacaaggaaactggcagggaaacaaagtatccctggaaggaatttcttaaagaggaagaggcagatccctacaagtttaaaatcaaagaatttgaagatgttgatcccaaagtgaaattgaaagatggacttgtgaggaaggagaaagagaagcataaagataagaagaaagatagagagaaaggcaagaaagataaagataagagagagaaagaaaaagtgaaagataaaggcagagaagataagatgaaagccccagcacccccactggtgttgcccccaaaagagttggccctgcccttgttcagccctgccacagcctccagggtcccagccatgctgccatctttgttgccagtgcttccggaaaaactgtttgaggagaaagagaaggtgaaggagaaagaaaagaaaaaggacaaaaaggagaagaagaaaaagaaggaaaaagagaaggagaagaaggagaaggaaagagagaaagagaagagagagcgagagaagagagaaaaagagaaggagaaacacaagcatgaaaaaataaaagtggaaccagtcgctctggccccgagtccagttatccccagattaactctccgagtcggtgctggccaagacaagattgtcatcagcaaggtggtccctgcccccgaggccaagccggcgccctcgcagaacaggccgaagaccccaccgccggcccccgcgcccgcccccggccccatgctcgtcagccctgcgcccgtgccgctgccgctgctcgcccaggccgccgcgggccctgccctgctgccctccccgggtcccgccgcctccggggccagtgccaaagcccccgtgcgcagcgtggtgactgagacggtcagcacctacgtgatccgagatgagtggggcaatcagatctggatctgccctgggtgtaacaagcctgacgatgggagtcccatgattgggtgtgacgactgcgatgactggtaccactggccctgtgttggaatcatgactgcacccccagaagagatgcagtggttctgccccaagtgtgcgaacaagaagaaggacaaaaagcacaagaagaggaagcatcgagcccactgacgactcccgaggggctggaccaagcggggtcagcccgggcttcttccctggcgcctctggaagggagctggtgcaagtctgccgtcacatccacccccagatgcctgtggataaagaacccaggaggactgaggctggaacacaccgcgcacctggattgttcactcccgagccgccttggcctgtggctccgtggcagtgcgacagaaggaaactcaagcagaggcgtggcctgggggctgcccctcctccacttctctaataccagtgacaagtattattaataaagagcgtacatcttcccttttgatttcctttattctctccagggccttttcattgaggtattagatgagaagataatgtacaaactgcctcaactgtaatttaaggatgatagagtctgtatacagttttcagcccctttccctctatagtaagataatcagaataacataaaagaaaactccagttggagtaccggtaaatatttttgtgataagaatatatgaagcttccctccttcccccgtttttagtactaacatgtaaaatgttcaggcttttgtgaaataccttatattttttaagaaaaaggtttctatcatgtcctgtttgcttttgtgcaaattatttttgtttaatgtattttatatcttcgttgcattctaattttgcccttctttaaactgctggagtctcttctcactgcttgtacatttcatcaacttgtataaaaactcttcagactaaaagattgcccctaatgtaaataataaatatttatgaagtagttattttttaaatttttatcgtgtttaattctggctttctctgaaatccactgtgatttcagccaggtctgtaatgacgctggacagaaacaaggctagagaaaaagccatcgttcaaagaaatttcccttgagctcagcctgcgcagtgcccggaaacatggtggggaaagggcccgagcagttggaaggaaaacaaggcaatttaaatttagagtttatgacttgaagttgttttgtttgttgtctattttgtttttgtaaatttctttgacagacttttactaaaaggacatgtagtttccatgaaagtaaaaaaaaaaaacaacaaaaaacccacatatactgtagcattttgtctttatattgttttatttctacaaatctgttcattaatattgtgctttaaggctgaaatgaagtatattatgaatttttttaagaaaactcatcaaatttcagggtatcacaaaactttattatattattatactgcccactatttattatatgttatagatgtctgagaggtaaaccaaatattttatttttaatgttaaaaaaacatcaaatttaactttattagcatattttagcaactttgggataaatacggacttttacttgattttgaaataatcccagtgtaggcccatgtgctggatctgttggatgctagaatatgggctttgaacctaatacaaatatattactagaaaatgtgatttttttaaatgccaagtaaattgatattagtgtatgaattagtcatattttaaaacattatgtggttagagaaatgcggttttctgccatgaatgttaagttgcaaatcagtggaaatggagtcgacctcttcggagcacagggtgtcattgccctcgttgttcaagaggccagaatttttctatccccgctaagaaacaaagcatctatgttgagatatgtgtttttttgtttgattaatttgagatcattctaaatactttatacaatattttcacatgcacaaaaatgcgcgttagtggtttttggagaggggtgaggggtgggggaagtgcaaaataaagattattggctattt

SEQ ID NO: 30909 - DNA, 1021 bp, Homo sapiens
ctcaggctggcgcgctccgtgctgctggggctttgaggtggtcgccgggggtccgggggaccctttccccgccgcggaagccctagaggatgaatcggggaccctgctaaggtctggcggcggggctggagagcagtggcagcaagggctgcggtggcgtccacgcagcgggatgtgcgagagttactccaggtcgttgttgagggtctcggtggcgcagatctgccaggcgctgggctgggactcggtgcagctcagcgcctgccacctcctcacggacgtgctgcagcgctatctgcagcagctgggccggggctgccatcggtactctgagctctatggccgaacagacccaattttggatgatgttggtgaagctttccagctgatgggggttagtctacatgaactagaagactatattcacaacattgagcctgtcaccttcccacaccaaattccgtcatttcctgttagcaagaacaatgtacttcagtttcctcaacctggaagtaaagatgcagaggaaagaaaagaatacattcctgattacctgccacccattgtgtcttctcaagaagaagaagaagaagagcaggtgcccactgatggaggcacatcagcagaagccatgcaggttcccttggaagaagatgatgaattggaggaggaagaaattattaatgatgagaatttcctgggcaagagaccactggatagtcctgaagctgaagaactgccagccatgaagcggcctcggctattaagcactaaaggggacacgctagatgttgtgttattggaagctcgagagccactcagctcaataaatactcaaaagatcccaccaatgctttctccagtccatgtacaggacagtacagacttggcacctccctcacccgagccgccaatgttggctccagttgcaaaatcacaaatgccaactgcaaaaccattagaaacaaagtcatttacacctaaaacaaagactaaaaaaaaaaaaaaaaaaaaaaagagt

SEQ ID NO: 30910 - DNA, 4630 bp, Homo sapiens
atggcggcgggctcggatctgctggacgaggtcttcttcaacagcgaggtggacgagaaagtggtgagcgacctggtgggctcgctggagtcgcagctggcggccagcgcggcccaccaccaccacctcgcgccgcgcacgcccgaggtgcgggccgcggccgccggcgcgctcgggaaccatgttgtgagcggcagcccggccggagccgcgggcgcagggccggccgcccccgccgagggcgcgcccggagcggcgccggagccgccccccgcaggtagagcgcggccggggggcggggggccgcagcgcccgggccccccctcaccgcgccgcccccttgtccccgcagggcccgcgccgcccgccgcgaagctgaggccgccgcccgagggcagcgcggggtcctgcgccccggtgcccgccgccgccgccgtcgccgcggggcccgagcccgcccccgccggccccgccaagcccgccggccccgccgcgctggccgcccgcgccggccccggccccgggcccggccccggccccggccccggccctggccctggcaagcccgccggccccggcgccgcgcaaactttgaatgggagcgccgcgctgctgaactcgcaccacgccgccgcacctgctgtcagcctggtcaacaacgggcccgccgcgctgctgccgctgcccaagcccgccgcccccggcactgtcatccagacgccccccttcgtgggcgccgccgcgccccccgcgcccgccgcgccctcgccccccgccgcccccgcgcccgccgcccccgccgccgccccgcccccgccaccccccgcgcccgccactctggcccggccgcccggccaccccgccggacccccgaccgccgcgcccgccgtgccgccccccgccgccgcccagaacgggggcagcgccggggcagcccccgcccccgccccggccgccgggggccccgcgggggtcagcggccaacccgggcccggcgcggcggctgcggcgccggcgccgggggtcaaggccgagtcgcccaagagggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggaatggtcctcgtccgaagtgagaatgggcagttgttaatgattcctcagcaggccttggcccagatgcaggcgcaggcccatgcccagcctcagaccaccatggcgcctcgccctgccacccccacaagtgcccctcccgtccagatctccaccgtacaggcacctggaacacctatcattgcacggcaggtgaccccaactaccataattaagcaagtgtctcaggcccagacaacggtgcagcccagtgcaaccctgcagcgctcgcccggcgtccagcctcagctcgttctgggtggcgctgcccagacggcttcacttgggacggcgacggctgttcagacggggactcctcagcgcacggtaccaggggcgaccaccacttcctcagctgccacggaaactatggaaaacgtgaagaaatgtaaaaatttcctatctacgttaataaaactggcttcatctggcaagcagtctacagagacagcagctaatgtgaaagagctcgtgcagaatttactggatggaaaaatagaagcagaagatttcacaagcaggttataccgagaacttaattcttcacctcaaccttaccttgtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcgggacgatgatgacattaatgatgttgcatcgatggctggagtaaacttgtcagaagaaagtgcaagaatattagccacgaactctgaattggtgggcacgctaacgcggtcctgtaaagatgaaaccttcctcctccaagcgcctttgcagagaagaatattagaaataggtaaaaaacatggtataacggaattacatccagatgtagtaagttatgtatcacatgccacgcaacaaaggctacagaatcttgtagagaaaatatcagaaacagctcagcagaagaacttttcttacaaggatgacgacagatatgagcaggcgagtgacgtccgggcacagctcaagttttttgaacagcttgatcaaatcgaaaagcagaggaaggatgagcaggagcgggagatcctgatgagggcagcaaagtctcggtcaagacaagaagatccagaacagttaaggctgaaacagaaggcaaaggagatgcagcaacaggaactggcacaaatgagacagcgggacgccaacctcacagcactagcagcgatcgggcccaggaaaaagaggaaagtggactgtccggggccgggctcaggagcagaggggtcgggccccggctcagtggtcccaggcagctcgggtgtcggaacccccagacagttcacgcgacaaagaatcacgcgggtcaacctcagggacctcatattttgtttagaaaatgaacgtgagacaagccattcactgctgctctacaaagcattccttaagtgacacaggaggacgcctggggactttttatatatttgcagattacgcctttttgtaacgagcaaatgggatattgtttaaaaaacagccacctctttacaatggaacagttttatattcctgtttctaaatcagctcttcagtgtgaaagaaaacacgtttctgtaacagagagaacacaaaggcctgtggatactcttaaaggacaattaaatcttaactcatcttgattgagtggccttcctgccaaacaagccatatataaagactgatggaatcgttagcaaataattagctgccctctgtcaactcatagcagtttctgcattatttgtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgtatt

SEQ ID NO: 30911 - DNA, 4222 bp, Homo sapiens
ggacgaggtcttcttcaacagcgaggtggacgagaaagtgggcccgcgccgcccgccgcgaagctgaggccgccgcccgagggcagcgcggggtcctgcgccccggtgcccgccgccgccgccgtcgccgcggggcccgagcccgcccccgccggccccgccaagcccgccggccccgccgcgctggccgcccgcgccggccccggccccgggcccggccccggccccggccccggccctggccctggcaagcccgccggccccggcgccgcgcaaactttgaatgggagcgccgcgctgctgaactcgcaccacgccgccgcacctgctgtcagcctggtcaacaacgggcccgccgcgctgctgccgctgcccaagcccgccgcccccgccgccgccccgcccccgccaccccccgcgcccgccactctggcccggccgcccggccaccccgccggacccccgaccgccgcgcccgccgtgccgccccccgccgccgcccagaacgggggcagcgccggggcagcccccgcccccgccccggccgccgggggccccgcgggggtcagcggccaacccgggcccggcgcggcggctgcggcgccggcgccgggggtcaaggccgagtcgcccaagagggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggaatggtcctcgtccgaagtgagaatgggcagttgttaatgattcctcagcaggccttggcccagatgcaggcgcaggcccatgcccagcctcagaccaccatggcgcctcgccctgccacccccacaagtgcccctcccgtccagatctccaccgtacaggcacctggaacacctatcattgcacggcaggtgaccccaactaccataattaagcaagtgtctcaggcccagacaacggtgcagcccagtgcaaccctgcagcgctcgcccggcgtccagcctcagctcgttctgggtggcgctgcccagacggcttcacttgggacggcgacggctgttcagacggggactcctcagcgcacggtaccaggggcgaccaccacttcctcagctgccacggaaactatggaaaacgtgaagaaatgtaaaaatttcctatctacgttaataaaactggcttcatctggcaagcagtctacagagacagcagctaatgtgaaagagctcgtgcagaatttactggatggaaaaatagaagcagaagatttcacaagcaggttataccgagaacttaattcttcacctcaaccttaccttgtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcgggacgatgatgacattaatgatgttgcatcgatggctggagtaaacttgtcagaagaaagtgcaagaatattagccacgaactctgaattggtgggcacgctaacgcggtcctgtaaagatgaaaccttcctcctccaagcgcctttgcagagaagaatattagaaataggtaaaaaacatggtataacggaattacatccagatgtagtaagttatgtatcacatgccacgcaacaaaggctacagaatcttgtagagaaaatatcagaaacagctcagcagaagaacttttcttacaaggatgacgacagatatgagcaggcgagtgacgtccgggcacagctcaagttttttgaacagcttgatcaaatcgaaaagcagaggaaggatgagcaggagcgggagatcctgatgagggcagcaaagtctcggtcaagacaagaagatccagaacagttaaggctgaaacagaaggcaaaggagatgcagcaacaggaactggcacaaatgagacagcgggacgccaacctcacagcactagcagcgatcgggcccaggaaaaagaggaaagtggactgtccggggccgggctcaggagcagaggggtcgggccccggctcagtggtcccaggcagctcgggtgtcggaacccccagacagttcacgcgacaaagaatcacgcgggtcaacctcagggacctcatattttgtttagaaaatgaacgtgagacaagccattcactgctgctctacaaagcattccttaagtgacacaggaggacgcctggggactttttatatatttgcagattacgcctttttgtaacgagcaaatgggatattgtttaaaaaacagccacctctttacaatggaacagttttatattcctgtttctaaatcagctcttcagtgtgaaagaaaacacgtttctgtaacagagagaacacaaaggcctgtggatactcttaaaggacaattaaatcttaactcatcttgattgagtggccttcctgccaaacaagccatatataaagactgatggaatcgttagcaaataattagctgccctctgtcaactcatagcagtttctgcattatttgtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgtatt

SEQ ID NO: 30912 - DNA, 4744 bp, Homo sapiens
gtggctatataaacatggctggcgtggccgcgcggcggggccgtgccaatcgcgcgtagggggctgtgggcactcggggttcgtagttttgaaatttctggcgggggagcagctgcgcagttaggctcgaggtgtgagcgacgaccttccgggagccgcaagtccaggctcccccgcagcgggacccgagcctgaggcgcagggctgaggcagcgcacgtgtgagcgccgctgaggaagctgcgagaggtcgggcgggtgtcgctccgggggcagcccaggctcgcgcggacgagaggaaggtccgggacgcgcgtgtcctgccgtgcagcgggcgcccgtcactgacttcgctgctgcggcccccgcgcctctccccagcgatgctgtggaacccgaaccgcaccggagtcggctgccgcgcgccaagcctcccctcacctctgctcccggaaccgcagcgccaaagctgccgctgagcccctgggggatgcccgccggcctcaccgaacccgccggcgccgctcccccggctgctgtgagcgcctcggggaccgtgaccatggccccggccggggcgctgccggtgcgggtggagagcactccggtggccctgggcgccgtgactaaggctcctgtcagcgtctgcgtggagcccacggcgtcccagcccctgcggtcccccgtggggaccctggtgaccaaagtggctccggtcagcgcccctcctaaagtcagcagcggccctaggctgcctgctcctcagatagtcgccgtgaaagcccccaacaccacgacaatccagtttcctgctaatttgcagcttcctccaggaaccgttttgattaaaagtaacagtggtccgttgatgttggtatctcctcagcaaactgtaacaagagccgagaccacaagtaacataacctcaaggccagcagtaccagcgaatcctcaaacagtcaaaatctgtacagtgccgaactctagctcacaattaatcaagaaagtggcagtgacacctgttaaaaaattggcacaaataggaactactgtggtaaccactgttccgaagccttcctcagtacaatctgtggctgtgccaaccagtgtcgtcacagttactcctggaaagccattgaatactgtaactaccctgaagccttcaagtttgggagcatcatccactccttcaaatgagcccaatcttaaagcagagaactcagcagctgttcagattaatctttctccgacaatgctagaaaatgtgaagaaatgcaagaacttccttgcaatgttaataaaactagcatgtagtggatcacagtccccagaaatggggcaaaatgtgaagaagctggtggaacaacttttggatgcaaaaatcgaagcagaagaatttactaggaaactgtatgttgaactcaagtcttcacctcagcctcacctggttccttttcttaagaaaagcgtggttgccttacgacaacttctgcctaactcccagagcttcatccagcaatgtgttcagcagacttctagtgacatggtcattgctacctgtactacaacagtaacaacttctcctgtggtgacaactacagtgtcctcaagccagtctgaaaagtcaattattgtttctggagcaacagcacccagaactgtgtcagtgcaaactttgaacccacttgctggtccagtgggagcaaaagctggagttgtgacacttcattctgtgggcccaactgctgcaacaggaggaacaacagctggaactggtttgcttcagacttcaaaaccacttgtgacatctgtggcaaacacagtgaccacggtctcactgcaacctgaaaagccagttgtctctggaacagcagtaacactgtcccttccagcagtaacttttggagaaacttcaggtgcagctatttgtcttccatctgtgaaacctgttgtttcttctgctgggaccacatctgacaagcctgttattgggactccagttcaaatcaaacttgcccagccgggccctgtcctttcacaaccagctgggattccacaggcagttcaagtcaagcaactagtagttcagcagccttcaggaggcaatgaaaaacaagtgaccacaatttcacattcctcaacattgaccattcagaaatgtggacagaagacgatgccagtgaacaccataatacctactagtcagtttcctccagcttccattctaaagcaaattactctgcctggaaataaaattctgtcacttcaagcatctcctactcagaaaaatagaataaaagagaatgtaacatcatgcttccgagatgaggatgacatcaatgatgtgacttctatggcaggggtcaaccttaatgaagaaaatgcctgcatcttagcaacaaactctgaattggttggcacactcattcagtcatgtaaagatgaaccatttctttttattggagctctacaaaagagaattttagacattggtaaaaagcatgacattacagaacttaactctgatgctgtgaacttgatctcccaagcaacacaggaacgactacgaggccttctagaaaaactgactgcaattgctcagcatcgaatgactacttacaaggcaagtgaaaattacatcctgtgtagtgataccaggtcacagctcaaatttcttgaaaagctggatcaattggagaagcagagaaaggatttggaagaaagagaaatgttacttaaggcagccaagagtcgttctaataaagaagatccagaacagctgagattaaagcagaaagccaaagagttacagcaattggaacttgcacagatacagcatagagacgctaatctcacagctcttgcagctattggaccaaggaagaagagaccactagaatctggaattgagggcttaaaagacaaccttcttgcttctgggacatccagcctgacagccaccaaacagttgcatcgtccaagaatcacgagaatctgcctcagggacttgatattttgtatggaacaggaacgggagatgaagtattctcgagctctatacctggcccttctgaagtgaccactccactcttccatccagatccttgctatttactgccaaagaagacacaaagcattgttgcactgtcctgaaatttcaatttctggaaaataatcaccaacatgaaagagcattgtttacagttagaaactttattaactcttacctatccatctcatgggactcttacagactcagattcatctttgtcttctgaaaatcagttatgaaatacactttgcacagaattaggcatctgcctatctgtgcattaaattaaagcaagttaaggccctatttgttactacctgcctcatttgccaaattgtagcaggtgaggtgtccttccctaatacagcatgcattgagatgcaggagaaaggaagaggcataagaaaatacaagaatgactatttcattctatattgaacctgtcccaaagtggtaggttttctgggctggaatcagaagttgcttagctaactatgacagtcaccctctgtacgtgacaggccactgtggtgactttggtcggctgagttccagtgttgtcaaaacaagacaaatggggatagattgtgcctggggttgctaattctctgcttcatatcaccatatgccgtttctggtaccaagtgaggggacatgcttgtcagggaaaccttaaaattgaatctactgatatatcttgttgaaaaaatggaaaaggtgcaaagtattagaaggaacgttagggcgttgctttcaaactgatgaggggaatgtgaaaatggtatcataaaacaggaaatgtgcttcatatgcccaagaggggaagaggtggaatcggaactccaaaacaactggtacatgttttgttgatgggcaaaaaaaatcacagcacaaccagaaaggagaatgtaccagatgttttcaaattagagtatttcaaaaggaaaatgttattttttgttttgtattgttttaaatcccaaggatagtttttatagttccttctgtcataatatattttagttatcctaatttttaagcatgttggcacatttaaaaaatcctaattgatgatgagaaatttttaacaataggactttatgttggattctgtacttaaaaggtactgtcaatatctcactcttggggatatgagctctaaatatgagaagcaagttatatgtgttcacctgaggaagaagctgacggacaaagcaaaccctctttaaaaaaaaaaaaaagaaaattccacgtgtgtggaatacagccggtgaaaaataatcactgtagttagaatcacatacagaaaaaaaatgattgaatcctccaagaaggtatttcaaaaatgggaaatgctatacttataagaattgaaggaaaaaaaaaaaaacacctcacgtatgttattcttcatcctgttcttcccattgggactgttatggccatattctacagtatagtaaattttaaattggccacatttttttttgtttcagcaagttatgtaaaatgctataaattatgtgtatgttaaaggagtactttaagaagagatctttatccaaagttgtttttgtatatttaaatgcttacctttattttttgtaaagtgcagcatactcatttgtgtataatcttactgatcagatgtttaaaattattccaaatacttcattaaaataattattttatt

SEQ ID NO: 30913 - DNA, 2346 bp, Homo sapiens
gtggctatataaacatggctggcgtggccgcgcggcggggccgtgccaatcgcgcgtagggggctgtgggcactcggggttcgtagttttgaaatttctggcgggggagcagctgcgcagttaggctcgaggtgtgagcgacgaccttccgggagccgcaagtccaggctcccccgcagcgggacccgagcctgaggcgcagggctgaggcagcgcacgtgtgagcgccgctgaggaagctgcgagaggtcgggcgggtgtcgctccgggggcagcccaggctcgcgcggacgagaggaaggtccgggacgcgcgtgtcctgccgtgcagcgggcgcccgtcactgacttcgctgctgcggcccccgcgcctctccccagcgatgctgtggaacccgaaccgcaccggagtcggctgccgcgcgccaagcctcccctcacctctgctcccggaaccgcagcgccaaagctgccgctgagcccctgggggatgcccgccggcctcaccgaacccgccggcgccgctcccccggctgctgtgagcgcctcggggaccgtgaccatggccccggccggggcgctgccggtgcgggtggagagcactccggtggccctgggcgccgtgactaaggctcctgtcagcgtctgcgtggagcccacggcgtcccagcccctgcggtcccccgtggggaccctggtgaccaaagtggctccggtcagcgcccctcctaaagtcagcagcggccctaggctgcctgctcctcagatagtcgccgtgaaagcccccaacaccacgacaatccagtttcctgctaatttgcagcttcctccaggaaccgttttgattaaaagtaacagtggtccgttgatgttggtatctcctcagcaaactgtaacaagagccgagaccacaagtaacataacctcaaggccagcagtaccagcgaatcctcaaacagtcaaaatctgtacagtgccgaactctagctcacaattaatcaagaaagtggcagtgacacctgttaaaaaattggcacaaataggaactactgtggtaaccactgttccgaagccttcctcagtacaatctgtggctgtgccaaccagtgtcgtcacagttactcctggaaagccattgaatactgtaactaccctgaagccttcaagtttgggagcatcatccactccttcaaatgagcccaatcttaaagcagagaactcagcagctgttcagattaatctttctccgacaatgctagaaaatgtgaagaaatgcaagaacttccttgcaatgttaataaaactagcatgtagtggatcacagtccccagaaatggggcaaaatgtgaagaagctggtggaacaacttttggatgcaaaaatcgaagcagaagaatttactaggaaactgtatgttgaactcaagtcttcacctcagcctcacctggttccttttcttaagaaaagcgtggttgccttacgacaacttctgcctaactcccagagcttcatccagcaatgtgttcagcagacttctagtgacatggtcattgctacctgtactacaacagtaacaacttctcctgtggtgacaactacagtgtcctcaagccagtctgaaaagtcaattattgtttctggagcaacagcacccagaactgtgtcagtgcaaactttgaacccacttgctggtccagtgggagcaaaagctggagttgtgacacttcattctgtgggcccaactgctgcaacaggaggaacaacagctggaactggtttgcttcagacttcaaaaccacttgtgacatctgtggcaaacacagtgaccacggtctcactgcaacctgaaaagccagttgtctctggaacagcagtaacactgtcccttccagcagtaacttttggagaaacttcaggtgcagctatttgtcttccatctgtgaaacctgttgtttcttctgctgggaccacatctgacaagcctgttattgggactccagttcaaatcaaacttgcccagccgggccctgtcctttcacaaccagctgggattccacaggcagttcaagtcaagcaactagtagttcagcagccttcaggaggcaatgaaaaacaagtgaccacaatttcacattcctcaacattgaccattcagaaatgtggacagaagacgatgccagtgaacaccataatacctactagtcagtttcctccagcttccattctaaagcaaattactctgcctggaaataaaattctgtcacttcaagcatctcctactcagaaaaatagaataaaagagaatgtaacatcatgcttccggtctacttttatatgcgtatattaa

SEQ ID NO: 30914 - DNA, 4753 bp, Homo sapiens
gtggctatataaacatggctggcgtggccgcgcggcggggccgtgccaatcgcgcgtagggggctgtgggcactcggggttcgtagttttgaaatttctggcgggggagcagctgcgcagttaggctcgaggtgtgagcgacgaccttccgggagccgcaagtccaggctcccccgcagcgggacccgagcctgaggcgcagggctgaggcagcgcacgtgtgagcgccgctgaggaagctgcgagaggtcgggcgggtgtcgctccgggggcagcccaggctcgcgcggacgagaggaaggtccgggacgcgcgtgtcctgccgtgcagcgggcgcccgtcactgacttcgctgctgcggcccccgcgcctctccccagcgatgctgtggaacccgaaccgcaccggagtcggctgccgcgcgccaagcctcccctcacctctgctcccggaaccgcagcgccaaagctgccgctgagcccctgggggatgcccgccggcctcaccgaacccgccggcgccgctcccccggctgctgtgagcgcctcggggaccgtgaccatggccccggccggggcgctgccggtgcgggtggagagcactccggtggccctgggcgccgtgactaaggctcctgtcagcgtctgcgtggagcccacggcgtcccagcccctgcggtcccccgtggggaccctggtgaccaaagtggctccggtcagcgcccctcctaaagtcagcagcggccctaggctgcctgctcctcagatagtcgccgtgaaagcccccaacaccacgacaatccagtttcctgctaatttgcagcttcctccaggaaccgttttgattaaaagtaacagtggtccgttgatgttggtatctcctcagcaaactgtaacaagagccgagaccacaagtaacataacctcaaggccagcagtaccagcgaatcctcaaacagtcaaaatctgtacagtgccgaactctagctcacaattaatcaagaaagtggcagtgacacctgttaaaaaattggcacaaataggaactactgtggtaaccactgttccgaagccttcctcagtacaatctgtggctgtgccaaccagtgtcgtcacagttactcctggaaagccattgaatactgtaactaccctgaagccttcaagtttgggagcatcatccactccttcaaatgagcccaatcttaaagcagagaactcagcagctgttcagattaatctttctccgacaatgctagaaaatgtgaagaaatgcaagaacttccttgcaatgttaataaaactagcatgtagtggatcacagtccccagaaatggggcaaaatgtgaagaagctggtggaacaacttttggatgcaaaaatcgaagcagaagaatttactaggaaactgtatgttgaactcaagtcttcacctcagcctcacctggttccttttcttaagaaaagcgtggttgccttacgacaacttctgcctaactcccagagcttcatccagcaatgtgttcagcagacttctagtgacatggtcattgctacctgtactacaacagtaacaacttctcctgtggtgacaactacagtgtcctcaagccagtctgaaaagtcaattattgtttctggagcaacagcacccagaactgtgtcagtgcaaactttgaacccacttgctggtccagtgggagcaaaagctggagttgtgacacttcattctgtgggcccaactgctgcaacaggaggaacaacagctggaactggtttgcttcagacttcaaaaccacttgtgacatctgtggcaaacacagtgaccacggtctcactgcaacctgaaaagccagttgtctctggaacagcagtaacactgtcccttccagcagtaacttttggagaaacttcaggtgcagctatttgtcttccatctgtgaaacctgttgttttctgctgggaccacatcaagcctgttattgggactccagttcaaatcaaacttgcccagccgggccctgtcctttcacaaccagctgggattccacaggcagttcaagtcaagcaactattctcattgtttcaggtagttcagcagccttcaggaggcaatgaaaaacaagtgaccacaatttcacattcctcaacattgaccattcagaaatgtggacagaagacgatgccagtgaacaccataatacctactagtcagtttcctccagcttccattctaaagcaaattactctgcctggaaataaaattctgtcacttcaagcatctcctactcagaaaaatagaataaaagagaatgtaacatcatgcttccgagatgaggatgacatcaatgatgtgacttctatggcaggggtcaaccttaatgaagaaaatgcctgcatcttagcaacaaactctgaattggttggcacactcattcagtcatgtaaagatgaaccatttctttttattggagctctacaaaagagaattttagacattggtaaaaagcatgacattacagaacttaactctgatgctgtgaacttgatctcccaagcaacacaggaacgactacgaggccttctagaaaaactgactgcaattgctcagcatcgaatgactacttacaaggcaagtgaaaattacatcctgtgtagtgataccaggtcacagctcaaatttcttgaaaagctggatcaattggagaagcagagaaaggatttggaagaaagagaaatgttacttaaggcagccaagagtcgttctaataaagaagatccagaacagctgagattaaagcagaaagccaaagagttacagcaattggaacttgcacagatacagcatagagacgctaatctcacagctcttgcagctattggaccaaggaagaagagaccactagaatctggaattgagggcttaaaagacaaccttcttgcttctgggacatccagcctgacagccaccaaacagttgcatcgtccaagaatcacgagaatctgcctcagggacttgatattttgtatggaacaggaacgggagatgaagtattctcgagctctatacctggcccttctgaagtgaccactccactcttccatccagatccttgctatttactgccaaagaagacacaaagcattgttgcactgtcctgaaatttcaatttctggaaaataatcaccaacatgaaagagcattgtttacagttagaaactttattaactcttacctatccatctcatgggactcttacagactcagattcatctttgtcttctgaaaatcagttatgaaatacactttgcacagaattaggcatctgcctatctgtgcattaaattaaagcaagttaaggccctatttgttactacctgcctcatttgccaaattgtagcaggtgaggtgtccttccctaatacagcatgcattgagatgcaggagaaaggaagaggcataagaaaatacaagaatgactatttcattctatattgaacctgtcccaaagtggtaggttttctgggctggaatcagaagttgcttagctaactatgacagtcaccctctgtacgtgacaggccactgtggtgactttggtcggctgagttccagtgttgtcaaaacaagacaaatggggatagattgtgcctggggttgctaattctctgcttcatatcaccatatgccgtttctggtaccaagtgaggggacatgcttgtcagggaaaccttaaaattgaatctactgatatatcttgttgaaaaaatggaaaaggtgcaaagtattagaaggaacgttagggcgttgctttcaaactgatgaggggaatgtgaaaatggtatcataaaacaggaaatgtgcttcatatgcccaagaggggaagaggtggaatcggaactccaaaacaactggtacatgttttgttgatgggcaaaaaaaatcacagcacaaccagaaaggagaatgtaccagatgttttcaaattagagtatttcaaaaggaaaatgttattttttgttttgtattgttttaaatcccaaggatagtttttatagttccttctgtcataatatattttagttatcctaatttttaagcatgttggcacatttaaaaaatcctaattgatgatgagaaatttttaacaataggactttatgttggattctgtacttaaaaggtactgtcaatatctcactcttggggatatgagctctaaatatgagaagcaagttatatgtgttcacctgaggaagaagctgacggacaaagcaaaccctctttaaaaaaaaaaaaaagaaaattccacgtgtgtggaatacagccggtgaaaaataatcactgtagttagaatcacatacagaaaaaaaatgattgaatcctccaagaaggtatttcaaaaatgggaaatgctatacttataagaattgaaggaaaaaaaaaaaaacacctcacgtatgttattcttcatcctgttcttcccattgggactgttatggccatattctacagtatagtaaattttaaattggccacatttttttttgtttcagcaagttatgtaaaatgctataaattatgtgtatgttaaaggagtactttaagaagagatctttatccaaagttgtttttgtatatttaaatgcttacctttattttttgtaaagtgcagcatactcatttgtgtataatcttactgatcagatgtttaaaattattccaaatacttcattaaaataattattttatt

SEQ ID NO: 30915 - DNA, 3099 bp, Homo sapiens
gcgcgaggtggctcagccgcaagatggcggcgctggcggaggagcagacggaggtggcggtcaagctagagcctgagggaccgccaacgctgctacctccgcaggcgggggacggcgcaggcgagggtagcggcggcactaccaacaacggccccaacggcggcggcgggaacgttgcggcgtcgtcgtccactggcggggatggcgggacccccaagcccacggtggctgtctccgccgctgccccggcgggggcggccccggtgcccgccgctgctccggacgccggcgctccgcatgaccgacagactctactggccgtgctgcagttcctacggcagagcaaactccgcgaggccgaagaggcgctgcgccgtgaggccgggctgctggaggaggcagtggcgggctccggagccccgggagaggtggacagcgccggcgctgaggtgaccagcgcgcttctcagccgggtgaccgcctcggcccctggccctgcggcccccgaccctccgggcactggcgcttcgggggccacggtcgtctcaggttcagcctcaggtcctgcggctccgggtaaagttggaagtgttgctgtggaagaccagccagatgtcagtgccgtgttgtcagcctacaaccaacaaggagatcccacaatgtatgaagaatactatagtggactgaaacacttcattgaatgttccctggactgccatcgggcagagttgtcccaacttttttatcctctgtttgtgcacatgtacttggagctagtctacaatcaacatgagaatgaagcaaagtcattctttgagaagttccatggagatcaggaatgttattaccaggatgacctacgagtattatctagtcttaccaaaaaggaacacatgaaagggaatgagaccatgttggattttcgaacaagtaaatttgttctgcgtatttcccgtgactcgtaccaactcttgaagaggcatcttcaggagaaacagaacaatcagatatggaacatagttcaggagcacctctacattgacatctttgatgggatgccgcgtagtaagcaacagatagatgcgatggtgggaagtttggcaggagaggctaaacgagaggcaaacaaatcaaaggtattttttggtttattaaaagaaccagaaattgaggtacctttggatgacgaggatgaagagggagaaaatgaagaaggaaaacctaaaaagaagaagcctaaaaaagatagtattggatccaaaagcaaaaaacaagatcccaatgctccacctcagaacagaatccctcttcctgagttgaaagattcagataagttggataagataatgaatatgaaagaaaccaccaaacgagtgcgccttgggccggactgcttaccctccatttgtttctatacatttctcaatgcttaccagggtctcactgcagtggatgtcactgatgattctagtctgattgctggaggttttgcagattcaactgtcagagtgtggtcggtaacacccaaaaagcttcgtagtgtcaaacaagcatcagatcttagtcttatagacaaagaatcagatgatgtcttagaaagaatcatggatgagaaaacagcaagtgagttgaagattttgtatggtcacagtgggcctgtctacggagccagcttcagtccggataggctctgggctacagaccactatcagcctttaagaatatttgccggccatcttgctgatgtgaattgtaccagattccatccaaattctaattatgttgctacgggctctgcagacagaactgtgcggctctgggacgtcctgaatggtaactgtgtaaggatcttcactggacacaagggaccaattcattccttgacattttctcccaatgggagattcctggctacaggagcaacagatggcagagtgcttctttgggatattggacatggtttgatggttggagaattaaaaggccacactgatacagtctgttcacttaggtttagtagagatggtgaaattttggcatcaggttcaatggataatacagttcgattatgggatgctatcaaagcctttgaagatttagagaccgatgactttactacagccactgggcatataaatttacctgagaattcacaggagttattgttgggaacatatatgaccaaatcaacaccagttgtacaccttcattttactcgaagaaacctggttctagctgcaggagcttatagtccacaataaaccatcggtattaaagaccttttggaagctactgtttttaaaaagggagactaaaagcaaatacctcagtgattaatatttaagctacagagaatgtttttgtctatatggatctggaagtatgctgcttggaaaaatctgaacaggacagttccacgtttctatagcaaccacatttgactaatttccgttagttgaataagaggtattatgatcatggaggggacatttatggtgctttggattgtgtggaaactatgcattttctgttcaaatgctattttaatttattacatttagaaaaaaagttgatttcaataattcatcctgcttcaagattcaaattcagaaatatactatcatcttgaattttagctgaagaatcctatgagcatgtatgtttctgctgtaaaaacgtagttactgtatggcactcaaaaactatgttaaatgatccactaactttttttttcttggcccatgattaatggaatgtatgtaactaggtagggttcctttcttagatctagaggaagtacagccacccactgacatctgaatttatatacctgttgagttttgagtgcacccaaacactcgataaaccaggtgaagaaatttagcttccatgttctacttcagctaaaacagctacatacaacctagtacacttgaagtcagacagacatttcagttgcttacctccagtactgagccttgctttgggaaactaaaagatttagaccaagtcactgccagtttttgcctttgttgcattttgtacagtttttatatttttgatatcttgtaaataaagacaaccagcttttccaggttc

SEQ ID NO: 30916 - DNA, 3268 bp, Homo sapiens
gcgcgaggtggctcagccgcaagatggcggcgctggcggaggagcagacggaggtggcggtcaagctagagcctgagggaccgccaacgctgctacctccgcaggcgggggacggcgcaggcgagggtagcggcggcactaccaacaacggccccaacggcggcggcgggaacgttgcggcgtcgtcgtccactggcggggatggcgggacccccaagcccacggtggctgtctccgccgctgccccggcgggggcggccccggtgcccgccgctgctccggacgccggcgctccgcatgaccgacagactctactggccgtgctgcagttcctacggcagagcaaactccgcgaggccgaagaggcgctgcgccgtgaggccgggctgctggaggaggcagtggcgggctccggagccccgggagaggtggacagcgccggcgctgaggtgaccagcgcgcttctcagccgggtgaccgcctcggcccctggccctgcggcccccgaccctccgggcactggcgcttcgggggccacggtcgtctcaggttcagcctcaggtcctgcggctccgggtaaagttggaagtgttgctgtggaagaccagccagatgtcagtgccgtgttgtcagcctacaaccaacaaggagatcccacaatgtatgaagaatactatagtggactgaaacacttcattgaatgttccctggactgccatcgggcagagttgtcccaacttttttatcctctgtttgtgcacatgtacttggagctagtctacaatcaacatgagaatgaagcaaagtcattctttgagaagttccatggagatcaggaatgttattaccaggatgacctacgagtattatctagtcttaccaaaaaggaacacatgaaagggaatgagaccatgttggattttcgaacaagtaaatttgttctgcgtatttcccgtgactcgtaccaactcttgaagaggcatcttcaggagaaacagaacaatcagatatggaacatagttcaggagcacctctacattgacatctttgatgggatgccgcgtagtaagcaacagatagatgcgatggtgggaagtttggcaggagaggctaaacgagaggcaaacaaatcaaaggtattttttggtttattaaaagaaccagaaattgaggtacctttggatgacgaggatgaagagggagaaaatgaagaaggaaaacctaaaaagaagaagcctaaaaaagatagtattggatccaaaagcaaaaaacaagatcccaatgctccacctcagaacagaatccctcttcctgagttgaaagattcagataagttggataagataatgaatatgaaagaaaccaccaaacgagtgcgccttgggccggactgcttaccctccatttgtttctatacatttctcaatgcttaccagggtctcactgcagtggatgtcactgatgattctagtctgattgctggaggttttgcagattcaactgtcagagtgtggtcggtaacacccaaaaagcttcgtagtgtcaaacaagcatcagatcttagtcttatagacaaagaatcagatgatgtcttagaaagaatcatggatgagaaaacagcaagtgagttgaagattttgtatggtcacagtgggcctgtctacggagccagcttcagtccggataggaactatctgctttcctcttcagaggacggaactgttagattgtggagccttcaaacatttacttgtttggtgggatataaaggacacaactatccagtatgggacacacaattttctccatatggatattattttgtgtcagggggccatgaccgagtagctcggctctgggctacagaccactatcagcctttaagaatatttgccggccatcttgctgatgtgaattgtaccagattccatccaaattctaattatgttgctacgggctctgcagacagaactgtgcggctctgggacgtcctgaatggtaactgtgtaaggatcttcactggacacaagggaccaattcattccttgacattttctcccaatgggagattcctggctacaggagcaacagatggcagagtgcttctttgggatattggacatggtttgatggttggagaattaaaaggccacactgatacagtctgttcacttaggtttagtagagatggtgaaattttggcatcaggttcaatggataatacagttcgattatgggatgctatcaaagcctttgaagatttagagaccgatgactttactacagccactgggcatataaatttacctgagaattcacaggagttattgttgggaacatatatgaccaaatcaacaccagttgtacaccttcattttactcgaagaaacctggttctagctgcaggagcttatagtccacaataaaccatcggtattaaagaccttttggaagctactgtttttaaaaagggagactaaaagcaaatacctcagtgattaatatttaagctacagagaatgtttttgtctatatggatctggaagtatgctgcttggaaaaatctgaacaggacagttccacgtttctatagcaaccacatttgactaatttccgttagttgaataagaggtattatgatcatggaggggacatttatggtgctttggattgtgtggaaactatgcattttctgttcaaatgctattttaatttattacatttagaaaaaaagttgatttcaataattcatcctgcttcaagattcaaattcagaaatatactatcatcttgaattttagctgaagaatcctatgagcatgtatgtttctgctgtaaaaacgtagttactgtatggcactcaaaaactatgttaaatgatccactaactttttttttcttggcccatgattaatggaatgtatgtaactaggtagggttcctttcttagatctagaggaagtacagccacccactgacatctgaatttatatacctgttgagttttgagtgcacccaaacactcgataaaccaggtgaagaaatttagcttccatgttctacttcagctaaaacagctacatacaacctagtacacttgaagtcagacagacatttcagttgcttacctccagtactgagccttgctttgggaaactaaaagatttagaccaagtcactgccagtttttgcctttgttgcattttgtacagtttttatatttttgatatcttgtaaataaagacaaccagcttttccaggttcataa

SEQ ID NO: 30917 - DNA, 2727 bp, Homo sapiens
gatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacggttggttgtgtgtctgtgctcgtggggaccccgtgtgtgtgcctgcattggagagatgttgcaggagatggggtgggctctctgaacctcctttcgcgctgcccggggatcttcgacctgcttctctgctgggatctcgcttaagttaacccttccctgggacgccttcctgccgcctccactgatctgaggagatcctgtgactgtagcgtgttttatgagcctttactggcagagggtaccgccgggtattgaaggattcgtaggagttcgccagggaagtgggacacgaccccctcttgtaaacccggcgccaggcacagaggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgt

SEQ ID NO: 30918 - DNA, 537 bp, Homo sapiens
aagatggcgccgagcgccgggtgagcagcgtctcggctgccgctagagttttcctgctccccgcgctcgggtggcgggggcgggtctgagtggtaccccggaggagaccctttgaagggtttccgtctgttacccaggctgttgtgcagtggcaccatcttggctcactgcagcctccaactcctcagttcaagcgatcctcctgcctcagcctcctaagtagctgggatgacaggttcacaccaccagggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagc

SEQ ID NO: 30919 - DNA, 2680 bp, Homo sapiens
gcggggccaagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacggttggttgtgtgtctgtgctcgtggggaccccgtgtgtgtgcctgcattggagagatgttgcaggagatggggtgggctctctgaacctcctttcgcgctgcccggggatcttcgacctgcttctctgctgggatctcgcttaagttaacccttccctgggacgccttcctgccgcctccactgatctgaggagatcctgtgactgtagcgtgttttatgagcctttactggcagagggtaccgccgggtattgaaggattcgtaggagttcgccagggaagtgggacacgaccccctcttgtaaacccggcgccaggcacagaggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgt

SEQ ID NO: 30920 - DNA, 321 bp, Homo sapiens
agagttttcctgctccccgcgctcgggtggcgggggcgggtctgagtggtaccccggaggagaccctttgaaggtcccttgtggggactggaaagaggacgaagtcttgctttgttgcccaggctggagtgcaatgacacagatctttgctcactgcaacctccgcctcccgggttcgagtgattcttctgcctcagcctcccgagtagctgtgattacagggtctccgtctctccaccgggggcttcatccttccagggaggagaagagggactccagaatggctgaggagaagaagctgaagcttagcaacactgtgct

SEQ ID NO: 30921 - DNA, 2318 bp, Homo sapiens
gttctgtgtcatcgtcctcctccttcaacatcccagcccaagcctcgtgcacggccaaaaaaaggaaaagcaatattcccaaccgcacaggtcccatgacaaagcgccgtctacaaacaatcaccgcttgccttcaacttcgggaagggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgcta

SEQ ID NO: 30922 - DNA, 871 bp, Homo sapiens
ctcggctgccgctagagttttcctgctccccgcgctcgggtggcgggggcgggtctgagtggtaccccggaggagaccctttgaaggtcccttgtggggactggaaagaggacgggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggact

SEQ ID NO: 30923 - DNA, 612 bp, Homo sapiens
gttttgtggcgcctcttgaaggtcctggcagccgggtagtgaaggaataaattgcagtaattacaccaagagggagtgctccttatatatagatgtagaaacaaacttttaaaatataatttcattctgcgagcctagaggacttattctgggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcat

SEQ ID NO: 30924 - DNA, 703 bp, Homo sapiens
ctgctcccacgagggggcggggccaagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacgggtttccgtctgttacccaggctgttgtgcagtggcaccatcttggctcactgcagcctccaactcctcagttcaagcgatcctcctgcctcagcctcctaagtagctgggatgacaggttcacaccaccagggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctga

SEQ ID NO: 30925 - DNA, 2297 bp, Homo sapiens
acgagggggcggggccaagatggcgccgagcgccggggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgta

SEQ ID NO: 30926 - DNA, 2464 bp, Homo sapiens
gacttgctcttaggctctgccaggacctgctcccacgagggggcggggccaagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacgggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgtaagttctga

SEQ ID NO: 30927 - DNA, 471 bp, Homo sapiens
gcggggccaagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacgggtttccgtctgttacccaggctgttgtgcagtggcaccatcttggctcactgcagcctccaactcctcagttcaagcgatcctcctgcctcagcctcctaagtagctgggatgacaggttcacaccaccaggctggagtgcaatgacacagatctttgctcactgcaacctccgcctcccgggttcgagtgattcttctgcctcagcctcccgagtagctgtgattacagggtctccgtctctccaccgggggcttcatccttccagggaggagaagagggactccagaatggctgaggagaagaagctgaagctta

SEQ ID NO: 30928 - DNA, 2551 bp, Homo sapiens
tagtagagatggggtttctccatgttggccaggctggtctcgaattcctgacctcaagtgatccgcccgcctcgtcctcccaaagtgctggtgggattacaggcgtgagccactgaacctggccccagcccagatttgtatctttctctgttacacctcagggctgactcacgtggggatggacataagacactcggagttcctcccctgtctccactgtcctccctttgttggccctctccctgtgtctcacgtttctttttcttctgcctgccccgttcctctgccagggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgta

SEQ ID NO: 30929 - DNA, 934 bp, Homo sapiens
caagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacgggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgc

SEQ ID NO: 30930 - DNA, 2274 bp, Homo sapiens
gcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacagcatatttagagaaaagacttggagcttaaataaaaactaaggcaaaatagacgcttagctgctgatctacagagaacttcttgtaattaaaagatttcaattcatagcaaactggtgttttaaactattgcagtagctggaactttttagtgtaaccagcatttattggagaagtgaatcacaaggaaataaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcaggaagagaaggttccggaagacagcaaagaagaaatatattgaatctccagatgttgaaaaagaagtgaaacgattgctgagtacagatgctgaagctgttagtactcggtgggaaataattgccgaagatgaaacaaaggaggcagaaaatcaaggcctggatatctcttctccaggaatgtctggtcacaggcagggccatgactcattagaacatgatgagcttcgggagatattcaatgacctcagcagcagcagtgaggatgaagatgagacccagcatcaagatgaagaagatataaacatcattgacacggaggaagatctggagagacagctacaggacaagctaaatgaatcagatgaacagcaccaggaaaatgaaggaaccaatcagctggttatgggaattcagaagcagattgacaacatgaaaggcaagctccaagagacccaggacagggcaaaacgacaagaggatctcatcatgaaagtggaaaatctggctctcaagaacagatttcaggctgtactggatgagctcaaacaaaaggaagaccgagaaaaggagcaactcagctctttgcaagaggagctagaatcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaataattgttttcccagttattcaaagcagctttctatatgtagagatgcaaattattaagttgtttccaatacaataaataaaagcatctgtttttcacttta

SEQ ID NO: 30931 - DNA, 2107 bp, Homo sapiens
atttgttcatcaaattacatcatgtaatttggattgactttggaaaatctacacatattggagaggagctaaggtaacgtctagaaataattaagttatgtcaaataaggtattgtctaactgtacacacatcattctagtgaggattatgggcaagatcttgtataatttagccagtactaccagaagtggtcaggagagggagcaagaggagtttttagtgatggttttctttttgctttcatgaactcaaaatcaagacatgagtgaaagccaggatgaagttcctgatgaagttgagaaccagtttatattgcgtctgcctctggaacatgcttgtactgtcaggaacctagcacgttctcaaagtgtcaagatgaaggataaactaaaaattgacttattgcctgatgggcgccatgcagttgttgaagtagaagatgtcccactagctgctaagctggttgacttgccttgtgttattgaaagcctgagaacgcttgataaaaaaaccttttataaaacagcagacatttctcagatgcttgtgtgcactgctgatggtgatatccacctttctccagaagaaccagctgcctctactgatcctaatatagtcaggaaaaaagaaagggggagagaagaaaaatgtgtctggaagcatggcattacgccaccacttaagaatgtcagaaagaaaaggttccggaaaacacaaaaaaaggtccctgatgtcaaagaaatggaaaaaagcagctttactgagtacattgaatctccagacgtggaaaatgaagtaaagagactgctgcgttcggatgctgaagccgtaagtacccgttgggaagtcattgctgaagatggaaccaaggaaatagaaagtcaaggctccatcccaggatttttgatatcctcgggaatgagcagccacaagcagggtcatacctcgtcagtcatggaaattcagaagcagattgagaaaaaggagaaaaagctccataagattcagaataaagcacaaagacagaaggatctcatcatgaaagtggaaaacctgacactcaagaatcattttcagtctgtgctggagcagcttgagttacaggaaaaacaaaaaaatgagaagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcctcctgagtagctgggactacagttgtgcaccaccacaccaaacaagaattgattatattgcttctgtgctatggtaccagcagattattcagccatgcttctaaaggcagtctagcctagaggccgtacagctgtttggtttgcatatgttttagcttttcttttggtttttagtatttcctaaaacataggggaaaaaacgaggtcatttctactaagcactaggacctgccatagtgagtttaagtgcctaccttgcagcagttaatactagattgtgttctgtctctgttcaggtaacaggactgcattcctgctcaaggatgattccttgctgctgcttatgttctgttgtttttaggatggagctggttgttattcaccaactaagggaacagttagagcagagatgaagaaattatgaactgttatccttattctgagccttctcctcctaaccctcatcagttaaggttaggaagaacaagatgccataatgcctatgaagacttctttaacaatcttgtttgggtttttttctaggtatattattagtgttttatggtctatgttctttaagcaataaataaattgttcattttaaa

SEQ ID NO: 30932 - DNA, 1579 bp, Homo sapiens
gcgttcgcctctacgttccgcgcgggagcccacgcgcggttcgtccggaacccacagaccagagacgcaggtcccagccttttcggtgtcggcgccagttcccggaggagcggacatgagtgaaagccaggatgaagttcctgatgaagttgagaaccagtttatattgcgtctgcctctggaacatgcttgtactgtcaggaacctagcacgttctcaaagtgtcaagatgaaggataaactaaaaattgacttattgcctgatgggcgccatgcagttgttgaagtagaagatgtcccactagctgctaagctggttgacttgccttgtgttattgaaagcctgagaacgcttgataaaaaaaccttttataaaacagcagacatttctcagatgcttgtgtgcactgctgatggtgatatccacctttctccagaagaaccagctgcctctactgatcctaatatagtcaggaaaaaagaaagggggagagaagaaaaatgtgtctggaagcatggcattacgccaccacttaagaatgtcagaaagaaaaggttccggaaaacacaaaaaaaggtccctgatgtcaaagaaatggaaaaaagcagctttactgagtacattgaatctccagacgtggaaaatgaagtaaagagactgctgcgttcggatgctgaagccgtaagtacccgttgggaagtcattgctgaagatggaaccaaggaaatagaaagtcaaggctccatcccaggatttttgatatcctcgggaatgagcagccacaagcagggtcatacctcgtcagaatatgatatgcttcgggagatgttcagtgattctagaagtaacaatgatgatgatgaggatgaggatgatgaagatgaggatgaggatgaggatgaggatgaagatgaagacaaagaagaggaggaggaagattgttctgaagagtatctggaaaggcagctgcaggccgagtttattgaatctggccagtatagggcaaatgaaggtaccagttcaatagtcatggaaattcagaagcagattgagaaaaaggagaaaaagctccataagattcagaataaagcacaaagacagaaggatctcatcatgaaagtggaaaacctgacactcaagaatcattttcagtctgtgctggagcagcttgagttacaggaaaaacaaaaaaatgagaagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcctc

SEQ ID NO: 30933 - DNA, 2132 bp, Homo sapiens
attttacaaccccaacgaggtgggccatggagtgccccgagggacagctccccatttcttcagaaaatgattcaacaccaacagtttcaacatcggaagtaactagccaacaagaaccccaaattcttgtcgaccgtgggtctgaaaccacctatgaaagcagcgccgacattgctggcgacgaaggcacccagattcctgccgacgaggacactcaaacggatgcggacagcagcgcccaggctgctgcccaggccccagaaaacttccaggaagggaaagacatgagtgaaagccaggatgaagttcctgatgaagttgagaaccagtttatattgcgtctgcctctggaacatgcttgtactgtcaggaacctagcacgttctcaaagtgtcaagatgaaggataaactaaaaattgacttattgcctgatgggcgccatgcagttgttgaagtagaagatgtcccactagctgctaagctggttgacttgccttgtgttattgaaagcctgagaacgcttgataaaaaaaccttttataaaacagcagacatttctcagatgcttgtgtgcactgctgatggtgatatccacctttctccagaagaaccagctgcctctactgatcctaatatagtcaggaaaaaagaaagggggagagaagaaaaatgtgtctggaagcatggcattacgccaccacttaagaatgtcagaaagaaaaggttccggaaaacacaaaaaaaggtccctgatgtcaaagaaatggaaaaaagcagctttactgagtacattgaatctccagacgtggaaaatgaagtaaagagactgctgcgttcggatgctgaagccgtaagtacccgttgggaagtcattgctgaagatggaaccaaggaaatagaaagtcaaggctccatcccaggatttttgatatcctcgggaatgagcagccacaagcagggtcatacctcgtcagtcatggaaattcagaagcagattgagaaaaaggagaaaaagctccataagattcagaataaagcacaaagacagaaggatctcatcatgaaagtggaaaacctgacactcaagaatcattttcagtctgtgctggagcagcttgagttacaggaaaaacaaaaaaatgagaagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcctcctgagtagctgggactacagttgtgcaccaccacaccaaacaagaattgattatattgcttctgtgctatggtaccagcagattattcagccatgcttctaaaggcagtctagcctagaggccgtacagctgtttggtttgcatatgttttagcttttcttttggtttttagtatttcctaaaacataggggaaaaaacgaggtcatttctactaagcactaggacctgccatagtgagtttaagtgcctaccttgcagcagttaatactagattgtgttctgtctctgttcaggtaacaggactgcattcctgctcaaggatgattccttgctgctgcttatgttctgttgtttttaggatggagctggttgttattcaccaactaagggaacagttagagcagagatgaagaaattatgaactgttatccttattctgagccttctcctcctaaccctcatcagttaaggttaggaagaacaagatgccataatgcctatgaagacttctttaacaatcttgtttgggtttttttctaggtatattattagtgttttatggtctatgttctttaagcaataaataaattgttcattttaaatgg

SEQ ID NO: 30934 - DNA, 2341 bp, Homo sapiens
acgaggtgggccatggagtgccccgagggacagctccccatttcttcagaaaatgattcaacaccaacagtttcaacatcggaagtaactagccaacaagaaccccaaattcttgtcgaccgtgggtctgaaaccacctatgaaagcagcgccgacattgctggcgacgaaggcacccagattcctgccgacgaggacactcaaacggatgcggacagcagcgcccaggctgctgcccaggccccagaaaacttccaggaagggaaagacatgagtgaaagccaggatgaagttcctgatgaagttgagaaccagtttatattgcgtctgcctctggaacatgcttgtactgtcaggaacctagcacgttctcaaagtgtcaagatgaaggataaactaaaaattgacttattgcctgatgggcgccatgcagttgttgaagtagaagatgtcccactagctgctaagctggttgacttgccttgtgttattgaaagcctgagaacgcttgataaaaaaaccttttataaaacagcagacatttctcagatgcttgtgtgcactgctgatggtgatatccacctttctccagaagaaccagctgcctctactgatcctaatatagtcaggaaaaaagaaagggggagagaagaaaaatgtgtctggaagcatggcattacgccaccacttaagaatgtcagaaagaaaaggttccggaaaacacaaaaaaaggtccctgatgtcaaagaaatggaaaaaagcagctttactgagtacattgaatctccagacgtggaaaatgaagtaaagagactgctgcgttcggatgctgaagccgtaagtacccgttgggaagtcattgctgaagatggaaccaaggaaatagaaagtcaaggctccatcccaggatttttgatatcctcgggaatgagcagccacaagcagggtcatacctcgtcagaatatgatatgcttcgggagatgttcagtgattctagaagtaacaatgatgatgatgaggatgaggatgatgaagatgaggatgaggatgaggatgaggatgaagatgaagacaaagaagaggaggaggaagattgttctgaagagtatctggaaaggcagctgcaggccgagtttattgaatctggccagtatagggcaaatgaaggtaccagttcaatagtcatggaaattcagaagcagattgagaaaaaggagaaaaagctccataagattcagaataaagcacaaagacagaaggatctcatcatgaaagtggaaaacctgacactcaagaatcattttcagtctgtgctggagcagcttgagttacaggaaaaacaaaaaaatgagaagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcctcctgagtagctgggactacagttgtgcaccaccacaccaaacaagaattgattatattgcttctgtgctatggtaccagcagattattcagccatgcttctaaaggcagtctagcctagaggccgtacagctgtttggtttgcatatgttttagcttttcttttggtttttagtatttcctaaaacataggggaaaaaacgaggtcatttctactaagcactaggacctgccatagtgagtttaagtgcctaccttgcagcagttaatactagattgtgttctgtctctgttcaggtaacaggactgcattcctgctcaaggatgattccttgctgctgcttatgttctgttgtttttaggatggagctggttgttattcaccaactaagggaacagttagagcagagatgaagaaattatgaactgttatccttattctgagccttctcctcctaaccctcatcagttaaggttaggaagaacaagatgccataatgcctatgaagacttctttaacaatcttgtttgggtttttttctaggtatattattagtgttttatggtctatgttctttaagcaataaataaattgttcattttaaatgga

SEQ ID NO: 30935 - DNA, 1283 bp, Homo sapiens
gcggctgggccgccggggcaggctaggggcgccgcggtgggcttcggggcctttggggccgtgggcttttgctgccgcccgccccttccggctcctccctgtagagcaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattc

SEQ ID NO: 30936 - DNA, 1461 bp, Homo sapiens
cccaggaaagcttgaaggcagagatagactcacgtctctaagacatatacataatatagccgcaaccgcggcggccttactttcccggagctgcatccccttttaggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaactttgcgacggaaatgtgtcatcgaaagccaggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcg

SEQ ID NO: 30937 - DNA, 1183 bp, Homo sapiens
cccaggaaagcttgaaggcagagatagactcacgtctctaagacatatacataatatagccgcaaccgcggcggccttactttcccggagctgcatccccttttaggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaactttgcgacggaaatgtgtcatcgaaagccaggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaa

SEQ ID NO: 30938 - DNA, 1648 bp, Homo sapiens
gtagagcaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaacagagtattccttttttctttctttaaattagaaaaaaagttaagtgttgtactcgatacaaagttcaaaaggtacaaaagagcatgttgaaaagttaggtctcccttccagaccaccctatccccaggcaccccaggttccttccctttaggaaataatgttactggtttcctatatgtctttttagaggttttatgcctgcacagtgtatatgtacatgtgtacattttttaaagaatataacagtatattatgcacactattctgtacctttcttttttcacttactatatttgaagattatatcatctcagtacagacctccctgttcttttttttagttgagatagatatacatatcatacaataaaatttaccattttgaagtgtataatcagaaccgggtatggtggcttatgcctgtaatcccagcaaatggggaggctgaggtggagaatcgcttgaggcaggagttcaagaccagcctgggcaacatagtgagaccttagactctaaaaataaacataaataaaatttataatccgttggtttttagcttattaacaaggttatgtaactgtcaccactgtggaggaagcagtgatgataaagggaactcctataccctttagcagtcactctctattctttcctcctcatccccttgcagtcactagtctactttctgtctctatggatttgcatattctggatatttcatataaatgggattatacagta

SEQ ID NO: 30939 - DNA, 966 bp, Homo sapiens
atgttgcttccgaacatcctgctcaccggtcagggcgcgcggccgggagggactgggctggggcaggctgggggcgcagagtgctctgggcatcgggcgcccaggtgggggcccctcactgccctcttcagaggccggccgagggccacgaggcggttgtcagcgccccgggagccgaccctcgcgggcgttgcgggaggcgagggaggggacgcggaacgttaattccgttggcctgaggctccgggggggggcgggggggggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagc

SEQ ID NO: 30940 - DNA, 588 bp, Homo sapiens
tacacgcgcgagccaccacacgtggccatgaacagtttttaaatctttataagttaaagcaaataggccaggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggc

SEQ ID NO: 30941 - DNA, 1331 bp, Homo sapiens
gtgccactgcactccagcctgggcgacaagagtgaaactctgtctcaaaaaaaaaattttacatatgattgctaattaggaaatttttcatttcagtcgtcaagaacttttaagggcagaggccaggtgagactctgtctcaaaaataaaaggaaaggcagaaggtggaccgcagtgtgataagtagtatttcacaaacagtatttttctgtggcttgtcttacaggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcga

SEQ ID NO: 30942 - DNA, 754 bp, Homo sapiens
atttcgtttgtaaaatgggttgttgattctttggcagggttggccttgggatttttagcgaaataacgtaaggccatatctgcttcccggtagagtcattaatggtggatgcctcactccttaggcctccgtgggccgtattttattttttctttgcttctgataaacgcctcagattagatttcggtaaacgagttcagatgtttgtgacgtgacgaaattgctgtatgcttttgttgagttacatcaaaggatccccccgccccttaaaaggaaggcatatagagcatttcgggtcgtttctcgcgtaggagtgggtctttgaagccatactcagggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacc

SEQ ID NO: 30943 - DNA, 761 bp, Homo sapiens
ccgaccctcgcgggcgttgcgggaggcgagggaggggacgcggaacgttaattccgttggcctgaggctccgggggggggcgggggggggtggagagaggtcggcagatccagctctccagcttggcaacctgcttagtctttctgaatctggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccc

SEQ ID NO: 30944 - DNA, 582 bp, Homo sapiens
acatcctgctcaccggtcagggcgcgcggccgggagggactgggctggggcaggctgggggcgcagagtgctctgggcatcgggcgcccaggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactat

SEQ ID NO: 30945 - DNA, 2713 bp, Homo sapiens
cctcctcccgctccccgcaggggtggagcctgagcgaggagcccgcgagctctcctctctcctctgtctccgcggatgacgagtggctggataacatggagtcgggcaagatggcgcctcccaagaacgctccgagagatgccttggtgatggcacagatcctgaaggatatgggaatcacagagtatgaaccaagggttataaatcaaatgttggaatttgctttccgttatgtgactacaattctggatgatgcaaaaatttattcgagccatgctaagaaacctaatgttgatgcagatgatgtgagactggcaatccagtgtcgtgctgaccaatcttttacctctcctcccccaagagattttttactggatatcgcaaggcagaaaaatcaaacccctttgccactgattaagccatatgcaggacctagactgccacctgatagatactgcttaacagctccaaactataggctgaagtccttaattaaaaagggacctaaccaagggagactagttccacgattaagtgttggtgctgttagtagcaaacctactactcctactatagcaaccccacaaacggtgtctgtcccaaataaagttgcaactccaatgtcagtgacaagccaaagatttacggtgcagattccaccttctcagtccacacctgtcaaaccagttcctgcaacaactgcagttcaaaatgttctgattaatccttcaatgattgggcccaaaaatattcttattaccaccaacatggtttcgtcacagaacacagccaatgaagcaaacccactgaagagaaaacatgaagatgatgatgacaatgatattatgtaaggaatatagtctagtctagatgcatttcaaaaggaaagttggttttgagcccagtatactgaactagaatattctagatcttgttttaccttaaaagactgaaatgtagctgcagtatttttcgtcagttaaaactgttagatctctttagtaaacatacaaatgtgtttttcagtaggcttcaattacaaacagttaagtacttgtttcttaatagtttcattaatgttgagtcctaatatggcaattctgtttttgagacacttttctgccttctatcactgatagtagcatttaagtttcagattctacagcctagtcagcagatttatctttgacagcataatttctgatctacatttaaatactactttattttataaggtaatatagttacttactgtcactagctaatttttttttttttaccaaatctctcaatataggaaacattttttggaaaggatggatttagaggagagattctaaatccattttggatgtatttgtttctttgacttccttaacttccaaactcaactccctttctagatcccattcattttctgcacctcccccataggcttgtttctctccattgctattaaatgtagaaggccatacctggaattttaaaaatattattcctggtaatacagctcagtgtcattttcctatttttaaaacatgctctacatgcctaatgttttgtgattcactttaacctgatggtttgcatttgctgtttttcactcttatgtcagagcagttgggttttaccccttagtttttatgcctgttaagctttactgtgcttttgacaggtagttttgggtcagttatattcagttttagtattgtattccaagttgataactcttccatgtttcacatttctaaatttaacagagatgctgtagcttaaaacatgttttgataagtaattacactggacctaggcaaaaccactgaagaacaagtgttcctttttaccacatacatattatgttttgatcactgctgcttgagccccgctattggtataattcagatcattttagcttgttgctgaggatgtcacatataagacaggatcaaacctgaaagacactaatggttcatcctctataaggccaacaaagaaaacaaattaatgtgatgtaacttgcatttatgtgcactctgcataggtttcccaataatactgtaatgttgctgaacacctttccctgttttccatttatacacatattaaagtcatattgggaaagatggcaaagcttttgagaatataaacacacctgttttgtttttcttaagttcaacatacttttgtagaatttgtaaaataaatgttcgtatcataattgagaatttatagccaaggatcctcaaaacagaagtttcatcttaggatagtgtttgatatatctaagaaagtccagtaacagagaagaaatgtctcaaatgtctcgtatcagttttagtgtttttcagtattagggaaaggtaatataaaaacaggtaaaatgtataaaaatagacctgatcaacatcataggagataaatattcattatatagcataggatattattacttgaatgttctcagggaggcagcaagtcagaaggcctaggttctagtcctagctccatcatttaccaactgtgtgaccttacttcacctcttagccttgttctcctcactagcagtaggaaagtaacacctaccctgcctacctcacagggctgttgtgagggttcaattggtatatgtgaaaattctttcagaattgtaaaatgctatatgactgtaaggaattattgcatttgttccaaggttaataaaaatttgagctta

SEQ ID NO: 30946 - DNA, 1890 bp, Homo sapiens
ccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgccccctgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccaagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggacccctgcagctgcagacatctgcttcaccaaggagctacactcccacttcttcagcttgggcaagtgtgtgcctgtgtgccgaggagcagaatttttccaagcagagaatgaggggaaaggtgttctagacacaggcaggcacatgccaggtgctggaaaaagaagagagaaaggagatggcgtctaccagaaggggatggacttcattttggagaagctcaaccatggggactgggtgcatatcttcccagaagggaaagtgaacatgagttccgaattcctgcgtttcaagtggggaatcgggcgcctgattgctgagtgtcatctcaaccccatcatcctgcccctgtggcatgtcggaatgaatgacgtccttcctaacagtccgccctacttcccccgctttggacagaaaatcactgtgctgatcgggaagcccttcagtgccctgcctgtactcgagcggctccgggcggagaacaagtcggctgtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttccccccgaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacagaaccataaagcatatgtgttggcttgttgtaaaa

SEQ ID NO: 30947 - DNA, 1794 bp, Homo sapiens
ccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgccccctgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccaagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggacccctgcagctgcagacatctgcttcaccaaggagctacactcccacttcttcagcttgggcaagtgtgtgcctgtgtgccgaggagatggcgtctaccagaaggggatggacttcattttggagaagctcaaccatggggactgggtgcatatcttcccagaagggaaagtgaacatgagttccgaattcctgcgtttcaagtggggaatcgggcgcctgattgctgagtgtcatctcaaccccatcatcctgcccctgtggcatgtcggaatgaatgacgtccttcctaacagtccgccctacttcccccgctttggacagaaaatcactgtgctgatcgggaagcccttcagtgccctgcctgtactcgagcggctccgggcggagaacaagtcggctgtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttccccccgaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacagaaccataaagcatatgtgttggcttgtt

SEQ ID NO: 30948 - DNA, 1793 bp, Homo sapiens
cgcgcccacggcctgtgaccccggcgaccgctccccagtgacgagagagcggggccgggcgctgctccggcctgacctgcgaagggacctcggtccagtcccctgttgcgccgcgccccctgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccaagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggacccctgcagctgcagacatctgcttcaccaaggagctacactcccacttcttcagcttgggcaagtgtgtgcctgtgtgccgaggagcagaatttttccaagcagagaatgaggggaaaggtgttctagacacaggcaggcacatgccaggtgctggaaaaagaagagagaaaggagatggcgtctaccagaaggggatggacttcattttggagaagctcaaccatggggactgggtgcatatcttcccagaaggaatcgggcgcctgattgctgagtgtcatctcaaccccatcatcctgcccctgtggcatgtcggaatgaatgacgtccttcctaacagtccgccctacttcccccgctttggacagaaaatcactgtgctgatcgggaagcccttcagtgccctgcctgtactcgagcggctccgggcggagaacaagtcggctgtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttccccccgaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacagaaccataaagcatatgtgttggcttgtt

SEQ ID NO: 30949 - DNA, 1740 bp, Homo sapiens
tttccggcggttgcaccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgccccctgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccaagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggacccctgcagctgcagacatctgcttcaccaaggagctacactcccacttcttcagcttgggcaagtgtgtgcctgtgtgccgaggagatggcgtctaccagaaggggatggacttcattttggagaagctcaaccatggggactgggtgcatatcttcccagaaggaatcgggcgcctgattgctgagtgtcatctcaaccccatcatcctgcccctgtggcatgtcggaatgaatgacgtccttcctaacagtccgccctacttcccccgctttggacagaaaatcactgtgctgatcgggaagcccttcagtgccctgcctgtactcgagcggctccgggcggagaacaagtcggctgtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttccccccgaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacaga

SEQ ID NO: 30950 - DNA, 798 bp, Homo sapiens
atgcctctgcacgtgaagtggccgttccccgcggtgccgccgctcacctggaccctggccagcagcgtcgtcatgggcttggtgggcacctacagctgcttctggaccaagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggacccctgcagctgcagacatctgcttcaccaaggagctacactcccacttcttcagcttgggcaagtgtgtgcctgtgtgccgaggagcagaatttttccaagcagagaatgaggggaaaggtgttctagacacaggcaggcacatgccaggtgctggaaaaagaagagagaaagggaaagtgaacatgagttccgaattcctgcgtttcaagtggggaatcgggcgcctgattgctgagtgtcatctcaaccccatcatcctgcccctgtggcatgtcggaatgaatgacgtccttcctaacagtccgccctacttcccccgctttggacagaaaatcactgtgctgatcgggaagcccttcagtgccctgcctgtactcgagcggctccgggcggagaacaagtcggctgtggagatgcggaaagccctgacggacttcattcaagaggaattccagcatctgaagactcaggcagagcagctccacaaccacctccagcctgggagatag

SEQ ID NO: 30951 - DNA, 11650 bp, Homo sapiens
atggtggccctgtccttaaagatttgtgtgcgccactgcaacgtggtgaagaccatgcagtttgaaccatctacagctgtgtacgatgcgtgtcgagtcattcgggaacgggtgcctgaggcacaaactgggcaagcttctgactatggactctttctttcggatgaagacccgaggaaagggatttggctggaagcgggcagaacactggattactacatgttgcggaatggggatattttggaatataaaaagaaacagagacctcagaaaatccggatgctggatggatctgtgaagacagtgatggtggatgattccaagactgtgggggagctcctggtcactatttgtagcagaataggaataacaaattatgaagaatactccttaatccaagaaactattgaagaaaagaaagaggaaggaacgggcacactcaaaaaagacaggacactgttacgagatgagaggaaaatggagaagttgaaggccaagctgcacacagatgatgacctaaattggctggatcacagccgaacattcagagaacaaggagtagatgaaaacgaaacgttgctgcttagacggaagttcttttactctgatcagaatgtagattcgagagaccccgtgcagctgaacttgctttatgttcaggcacgggatgacatcctgaatggctctcaccctgtctccttcgagaaagcttgtgagtttggtggatttcaagcccagatacaatttggacctcatgtggaacataaacacaaacctggatttttagatctgaaggaattcctgcccaaagaatatatcaagcagagaggagctgaaaagaggatctttcaggagcataagaactgcggagagatgagtgagatagaagccaaggtcaagtacgtcaaactcgcacggtccctccgcacatatggcgtgtccttcttcctggtgaaggagaagatgaaaggcaagaacaagctggtgcctcgcctgctggggatcaccaaagactcggtgatgcgcgtggatgagaagaccaaggaagtgctgcaggagtggcccctcaccaccgtcaagcgctgggcagcctcacccaagagcttcacactggattttggggagtatcaggaaagctactattcagtacaaaccaccgagggagagcagatatcccagctgattgcaggctacattgacatcatcctgaaaaagaaacaaagtaaagatcgatttggactagaaggtgatgaggagtcaaccatgttagaagagtccgtttccccaaaaaagtccaccatcttgcagcagcagttcaaccggaccgggaaggcagagcacggctcagtggcgctgccggccgtgatgcgctcgggctccagcgggcctgagaccttcaacgttggcagcatgccctcgccacagcagcaggtcatggttgggcagatgcaccgaggccacatgccgccactgacctcagcccagcaggccctgatggggaccatcaacacaagcatgcacgccgtccagcaggcccaggatgatctcagtgagctcgactcgctgccacctctcggccaggatatggcatctagggtatgggttcagaacaaagtcgacgaatccaaacacgaaatccattctcaagttgatgctatcacggccggaacggcttcagttgttaacctcacagctggtgaccctgcagacactgactacacagctgtgggatgtgcgatcaccactatttcttccaacctgacggagatgtccaagggtgtgaagctattggccgccctcatggatgatgaggtgggcagcggggaggacttgctcagagctgccaggaccctcgctggggcggtgtcagacttgctgaaagctgtgcagcctacttctggagagcctcgacagacagttttgactgctgctggcagcatcggacaagccagtggggatcttctgagacagattggagagaatgagactgatgagcgattccaggatgttttaatgagtttggccaaagctgttgccaatgcagctgccatgttggtactaaaggcaaagaatgttgcccaagtggccgaagacactgtcctacagaacagggtaattgctgctgccacccagtgtgccctctccacctcccagcttgtggcatgtgccaaggttgtgagccccactattagctcccctgtgtgccaggagcagctgattgaagcagggaagctggtggaccgctcggtggagaactgtgtccgtgcctgccaggcggccactaccgatagtgagctcctgaagcaggtcagcgcagcggccagcgtggtcagccaggccctccatgatctcctgcagcatgtgcggcagtttgccagccgaggcgagcccatcggccgctacgaccaggctactgacaccatcatgtgtgtcaccgagagcatcttcagctccatgggtgacgctggtgaaatggtgcgccaggcgcgggttctggcccaagccacatcagacctcgtcaatgccatgaggtcagatgcagaagccgaaatcgacatggagaattcaaagaagctcctggcagcagcaaaactcttagctgactccactgctcgcatggtggaagctgcaaagggggctgcagccaacccagagaatgaggaccagcagcaaaggctgagagaagctgcagaaggcctccgggtagcaaccaacgcagctgcccagaatgctattaagaaaaaaattgtcaaccgactggaggttgcagccaagcaggccgcagcggcagccacacagaccatcgccgcctcccagaatgcagctgtttccaacaagaaccctgcggcccagcagcagctggtccagagttgcaaggcagtggctgatcacatccctcagctggtccagggagtgagggggagccaagctcaagctgaagacctgagtgcccagctggctctcatcatctccagccagaacttcctccagcctggaagcaagatggtgtcctctgccaaagccgcagtgcccaccgtgagtgaccaggccgcagccatgcagctgagccagtgtgccaagaacctggccaccagcttggcggagctgcgtaccgcctcgcagaaggcccatgaagcttgtggtccgatggaaatcgattcagctctgaatacggtgcagacgcttaagaatgaactgcaggatgccaagatggcagccgtggagagccagctgaagccacttccaggggaaacgctggaaaaatgtgctcaggacctgggaagcacatccaaggcggtgggctcctccatggcacagctgctgacctgtgctgctcaaggcaacgaacactacacaggggtggctgctagagagacggcccaagctctgaaaacactggcccaggccgcccgtggagtggctgcatcgacaaccgaccccgcggccgcccatgccatgttagattctgctcgagacgtgatggagggctccgccatgctcattcaagaggccaagcaggccctgattgcacctggagatgcagagcgtcaacaaagactggctcaggtggctaaagccgtctcacactccttgaataactgcgtaaattgcctccctgggcagaaggatgtggacgtggccttgaagagcatcggggagtccagcaagaagctgcttgtggattcgctacctccaagcacgaagcctttccaggaagcccagagtgaactgaaccaggcagcagctgatctgaaccagtctgctggggaagtggtccatgccacccggggccagagtggagagttggctgcagcctctggaaagttcagtgatgattttgatgaattcctcgatgctggcattgagatggctggccaagctcagacaaaagaagaccagatccaagtgatagggaacctcaagaatatctcgatggcatccagcaagctgctgttagctgccaagtctctctctgtagatccaggagctcccaatgcgaaaaatctcctggctgcagctgcaagagctgtgacagagagcatcaatcaactcatcactctgtgtacccaacaagctccgggccagaaagagtgcgataatgccctgcgggagctcgagactgtgaaggggatgttggacaatcctaatgaacctgttagtgacctctcttactttgactgcattgagagtgtgatggaaaactccaaggttctgggtgaatcgatggcagggatttcacagaatgccaagaccggagacctccctgcctttggggaatgtgtggggattgcatccaaggctctctgtgggctgacagaggctgcagcccaggctgcatacttggttggcatctctgatccaaacagccaggcaggccaccagggcctggtggaccccatccagtttgccagggctaaccaggccatccagatggcatgccagaacttggtggaccctggcagcagcccatcacaggtcctgtcagccgccacaattgttgccaagcacacgtcagccttgtgcaatgcctgccgcatcgcctcatccaagacggccaacccagtagccaagaggcacttcgtccagtcagccaaggaagtcgccaacagcactgccaacctggtgaagaccatcaaggccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaagccattgcggtgacagctcaggaaatgatgactaagtcggttactaacccggaggagttgggaggactggcttcacaaatgaccagtgactatgggcacctggctttccagggccagatggcagcagccacggcggaaccagaggagatcggattccagattcgcactcgtgtgcaggacctgggccacggctgtatcttcctggtgcagaaggcaggggccctccaggtctgccccacagacagctacaccaagagggagctgatcgaatgcgcccgtgccgtcacggaaaaggtctccttggtgctctcggctctccaggccgggaacaaaggaacccaggcatgcattacagccgccaccgctgtgtctgggatcattgccgacctggacaccaccattatgtttgcaacagcggggacgctgaatgcagagaacagtgagaccttcgcagaccacagggagaacattctcaagacggccaaggccttggtagaagacacgaaactacttgtgtcaggagctgcgtccactcctgacaagctggcccaggcggcccagtcctcagcagccaccatcacccagctcgcagaagtggtcaagctgggggcagccagcctgggctccgacgaccccgagacccaggtggttttgatcaatgccatcaaagatgtggccaaggccctttctgatctcatcagtgctaccaagggagctgccagcaagccagtggacgacccttccatgtaccagctcaagggggctgccaaggtgatggtgaccaatgtcacctcgctcctcaagactgtaaaggcagtggaggatgaggccacccggggcaccagggcgcttgaggccacaattgaatgcataaagcaggagcttacggtgttccagtcaaaagacgtacctgaaaagacatcatcacctgaagaatccataaggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaggtcgccgcttccacggctcagctgctggtggcctgcaaggtgaaggccgaccaggattcagaggccatgaggcggctacaggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtggaatgctcgtctccttagcgtccagggtggggattctgctggaataaagagcttcctcagtgactcatctttaggtcccacgctggtttctgtgccttcagaatggtcacaagcccggattggaaaggatctgcttacaaacctgtcccctgtcctccaacccaaaacgcctttttttctgtcttaatatccagaaaatctaaatgcatcctaaaatcaatgtgaacctttaacaagatagttttacttattatcacataagacataagatgttttcattttctggatgtcacacttccagaatttcatatttttcccctcttttctttccccttttcagagccctcccataggaagggaagggcttgaatttacccttaatctgcacctttagccaaggcagtgcatggaagatgaatggctcgtgggacagaatctaatgccagggagcaggagtgtttgaaagaattcatagtggggaaggtaaaagttaatggaagtacatgattttcaaaactggtaacagttaaaggcactcaccctccgcctctctctctctctctctctctggtgtgctatcatgtcttggactccatccacactatagtttcaaagttccactgacgggggaaagttggtgctttggtcctccgaagatgtcacctttcgaccttgcccgatcttgtttcaccagactctagcccatgtcatggttttaaaatacataaacttctgacagcttcccatatttataagttacttataagtgctgcacgtattagaatttttttttttcagaccagtaaagttagagaaaagacgctgtaaaggaaaagcaagtgagagtatgtgtaggacactgacagtgtgtgggcaccagttctgaagaggaggggagctgctggagccctagcctgttggggaaaagctggcacactcttggctcgccctctttgagtggagctgatccaacacctcatgcctgccttggccggacactgagaggaggggcacacgtgcttccagagacactcaggagtcagaccccaatgctcagagtcacaatgtgttcatggcctcctgtaacaggactctggggatcccctctgtggcccagcccaccccaccctctgctcttctatgctgtgcccagggcagctgccctcttctgcctgtgccccatcccatcctgaaaacccaggaccaaggcaggggcaggcagccagttcttccaccttgcctcagagtcatttaaaacctttactgcatttgataccagaaaagcctccagagacaaaccaaatgcaaaggcctttcctttataactctaaagaacaggcatcgaaagtttatttttgtaggagctatataaatactcacctttctggagtcgtccagtgctgggagctttggggagtttggttctcagttatcacctggtatggtcccagtttctcatctgtcctttcctcatccaccctgcacatgtgtatgtgaacggcttcgtggccggtgtggtggtttctcatttcataagatagttgaagggccatgccttgtctggatgttatttaataggcactactgcggtgtcctcagatggtactgagggggccttctggtccttcaaaggaaaataacacaggcatgagttcatttgggagtgtgaactttcagaacacctaataagagagtggtgtcagagtaaaaacggccccaggtctggagcatagaagtgtatctctgtgaagagagagccggtgtgttgacatgtggttcttctcacacccctctactcctcgagggctttgaatccttgggctgatttttgtgccagaaattgctgttcccgatggccaaaaggggaacctgaactggatttcagaactgcccagtgatttgaaaatttagattttacttgggcctttcaggagtctttagatagggatgctgaggtcatatttagttcaatgaacagcccttgtttaagttttgccagtgtccagccagctgtggccctggccatctgtgcaggcaggttcctcaattcctggttggccctgcagtcggtcaacacagtccctccaggtcggctgcagaggcagctgcccagcctgcagtctatgcacgggccttaagaaatgagctgcctgtagcctcacggcatatgcttttatcagggaaaacccttcgagcttcttctgattctcacctgcttgctttctggctgtcttagtcagtgtgtttacaggcaactaaagcctgttcctaatttatcaaaaaattataaccaaaattcaccatagcctaagagagtaaaccccacctccaaagtgatgccaaggccaaaacctcatcaaggaaccagacacaggtcaaaagtggtgagcaagccatggtctctgctcctggggaactcacacgctgacccccgaggagccttggtttcctccctggcagatagtccccagaatcttctctcccagctttgaggttctgggctctggaaaggcctctgggatgctggccttaagatctcagcacagactatcagcatgttccattctcagattcctggaggaaaggtaccctctgttgaccaaggggctggctgcttctgagacttaccaacccaagaaatttggagacattcccctcaggctaaaaggcagcggtccccagagttcagaaagcaaaagatcttgacaactgtgccagtagtggctctggtcctatctctccacagtgctggcctctgctggggaaggcatctttcccaaaggtatccccaagtaccatgttgaaaatgtcctcagtctgttgctccatctttctgagcctctgcttggtatgtcatgtttatggtcactacggatgagtgtgtgcagagtttgggttgattcttttaaatgctacaaacaagagctatttcttttcaataaaaaaggtttggattcggcctcttcctctgagcccacctcccagccctccagggagcatcagtgtacctgagtcactttgtctgcatctcttcatcccacaaaacacgaggctgggtctcattcagcggcctctcaccaaccttcaagatccagaagaaaacaggaacgttcagctctgccctgtgtcgtatctaatcacatacattaatttatctaaccacataagttatttttttttatttgccagaaataaacctttaaaggaacaaa

SEQ ID NO: 30952 - DNA, 11880 bp, Homo sapiens
cttcatttcctcaagctccctccttaacagctaacgccttcgcgagaggagctgagggccctatgcggaataattaagatgccttctttagggtctctgccttggggccattttacaggtgctgcaggaggcttctcacatgctttgggatatcttcagggaaatacgctcttaatagaaactgagaatttaagacattctaagtgagactgtccacatcatctaggaaaatggtggccctgtccttaaagatttgtgtgcgccactgcaacgtggtgaagaccatgcagtttgaaccatctacagctgtgtacgatgcgtgtcgagtcattcgggaacgggtgcctgaggcacaaactgggcaagcttctgactatggactctttctttcggatgaagacccgaggaaagggatttggctggaagcgggcagaacactggattactacatgttgcggaatggggatattttggaatataaaaagaaacagagacctcagaaaatccggatgctggatggatctgtgaagacagtgatggtggatgattccaagactgtgggggagctcctggtcactatttgtagcagaataggaataacaaattatgaagaatactccttaatccaagaaactattgaagaaaagaaagaggaaggaacgggcacactcaaaaaagacaggacactgttacgagatgagaggaaaatggagaagttgaaggccaagctgcacacagatgatgacctaaattggctggatcacagccgaacattcagagaacaaggagtagatgaaaacgaaacgttgctgcttagacggaagttcttttactctgatcagaatgtagattcgagagaccccgtgcagctgaacttgctttatgttcaggcacgggatgacatcctgaatggctctcaccctgtctccttcgagaaagcttgtgagtttggtggatttcaagcccagatacaatttggacctcatgtggaacataaacacaaacctggatttttagatctgaaggaattcctgcccaaagaatatatcaagcagagaggagctgaaaagaggatctttcaggagcataagaactgcggagagatgagtgagatagaagccaaggtcaagtacgtcaaactcgcacggtccctccgcacatatggcgtgtccttcttcctggtgaaggagaagatgaaaggcaagaacaagctggtgcctcgcctgctggggatcaccaaagactcggtgatgcgcgtggatgagaagaccaaggaagtgctgcaggagtggcccctcaccaccgtcaagcgctgggcagcctcacccaagagcttcacactggattttggggagtatcaggaaagctactattcagtacaaaccaccgagggagagcagatatcccagctgattgcaggctacattgacatcatcctgaaaaagaaacaaagtaaagatcgatttggactagaaggtgatgaggagtcaaccatgttagaagagtccgtttccccaaaaaagtccaccatcttgcagcagcagttcaaccggaccgggaaggcagagcacggctcagtggcgctgccggccgtgatgcgctcgggctccagcgggcctgagaccttcaacgttggcagcatgccctcgccacagcagcaggtcatggttgggcagatgcaccgaggccacatgccgccactgacctcagcccagcaggccctgatggggaccatcaacacaagcatgcacgccgtccagcaggcccaggatgatctcagtgagctcgactcgctgccacctctcggccaggatatggcatctagggtatgggttcagaacaaagtcgacgaatccaaacacgaaatccattctcaagttgatgctatcacggccggaacggcttcagttgttaacctcacagctggtgaccctgcagacactgactacacagctgtgggatgtgcgatcaccactatttcttccaacctgacggagatgtccaagggtgtgaagctattggccgccctcatggatgatgaggtgggcagcggggaggacttgctcagagctgccaggaccctcgctggggcggtgtcagacttgctgaaagctgtgcagcctacttctggagagcctcgacagacagttttgactgctgctggcagcatcggacaagccagtggggatcttctgagacagattggagagaatgagactgatgagcgattccaggatgttttaatgagtttggccaaagctgttgccaatgcagctgccatgttggtactaaaggcaaagaatgttgcccaagtggccgaagacactgtcctacagaacagggtaattgctgctgccacccagtgtgccctctccacctcccagcttgtggcatgtgccaaggttgtgagccccactattagctcccctgtgtgccaggagcagctgattgaagcagggaagctggtggaccgctcggtggagaactgtgtccgtgcctgccaggcggccactaccgatagtgagctcctgaagcaggtcagcgcagcggccagcgtggtcagccaggccctccatgatctcctgcagcatgtgcggcagtttgccagccgaggcgagcccatcggccgctacgaccaggctactgacaccatcatgtgtgtcaccgagagcatcttcagctccatgggtgacgctggtgaaatggtgcgccaggcgcgggttctggcccaagccacatcagacctcgtcaatgccatgaggtcagatgcagaagccgaaatcgacatggagaattcaaagaagctcctggcagcagcaaaactcttagctgactccactgctcgcatggtggaagctgcaaagggggctgcagccaacccagagaatgaggaccagcagcaaaggctgagagaagctgcagaaggcctccgggtagcaaccaacgcagctgcccagaatgctattaagaaaaaaattgtcaaccgactggaggttgcagccaagcaggccgcagcggcagccacacagaccatcgccgcctcccagaatgcagctgtttccaacaagaaccctgcggcccagcagcagctggtccagagttgcaaggcagtggctgatcacatccctcagctggtccagggagtgagggggagccaagctcaagctgaagacctgagtgcccagctggctctcatcatctccagccagaacttcctccagcctggaagcaagatggtgtcctctgccaaagccgcagtgcccaccgtgagtgaccaggccgcagccatgcagctgagccagtgtgccaagaacctggccaccagcttggcggagctgcgtaccgcctcgcagaaggcccatgaagcttgtggtccgatggaaatcgattcagctctgaatacggtgcagacgcttaagaatgaactgcaggatgccaagatggcagccgtggagagccagctgaagccacttccaggggaaacgctggaaaaatgtgctcaggacctgggaagcacatccaaggcggtgggctcctccatggcacagctgctgacctgtgctgctcaaggcaacgaacactacacaggggtggctgctagagagacggcccaagctctgaaaacactggcccaggccgcccgtggagtggctgcatcgacaaccgaccccgcggccgcccatgccatgttagattctgctcgagacgtgatggagggctccgccatgctcattcaagaggccaagcaggccctgattgcacctggagatgcagagcgtcaacaaagactggctcaggtggctaaagccgtctcacactccttgaataactgcgtaaattgcctccctgggcagaaggatgtggacgtggccttgaagagcatcggggagtccagcaagaagctgcttgtggattcgctacctccaagcacgaagcctttccaggaagcccagagtgaactgaaccaggcagcagctgatctgaaccagtctgctggggaagtggtccatgccacccggggccagagtggagagttggctgcagcctctggaaagttcagtgatgattttgatgaattcctcgatgctggcattgagatggctggccaagctcagacaaaagaagaccagatccaagtgatagggaacctcaagaatatctcgatggcatccagcaagctgctgttagctgccaagtctctctctgtagatccaggagctcccaatgcgaaaaatctcctggctgcagctgcaagagctgtgacagagagcatcaatcaactcatcactctgtgtacccaacaagctccgggccagaaagagtgcgataatgccctgcgggagctcgagactgtgaaggggatgttggacaatcctaatgaacctgttagtgacctctcttactttgactgcattgagagtgtgatggaaaactccaaggttctgggtgaatcgatggcagggatttcacagaatgccaagaccggagacctccctgcctttggggaatgtgtggggattgcatccaaggctctctgtgggctgacagaggctgcagcccaggctgcatacttggttggcatctctgatccaaacagccaggcaggccaccagggcctggtggaccccatccagtttgccagggctaaccaggccatccagatggcatgccagaacttggtggaccctggcagcagcccatcacaggtcctgtcagccgccacaattgttgccaagcacacgtcagccttgtgcaatgcctgccgcatcgcctcatccaagacggccaacccagtagccaagaggcacttcgtccagtcagccaaggaagtcgccaacagcactgccaacctggtgaagaccatcaaggccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaagccattgcggtgacagctcaggaaatgatgactaagtcggttactaacccggaggagttgggaggactggcttcacaaatgaccagtgactatgggcacctggctttccagggccagatggcagcagccacggcggaaccagaggagatcggattccagattcgcactcgtgtgcaggacctgggccacggctgtatcttcctggtgcagaaggcaggggccctccaggtctgccccacagacagctacaccaagagggagctgatcgaatgcgcccgtgccgtcacggaaaaggtctccttggtgctctcggctctccaggccgggaacaaaggaacccaggcatgcattacagccgccaccgctgtgtctgggatcattgccgacctggacaccaccattatgtttgcaacagcggggacgctgaatgcagagaacagtgagaccttcgcagaccacagggagaacattctcaagacggccaaggccttggtagaagacacgaaactacttgtgtcaggagctgcgtccactcctgacaagctggcccaggcggcccagtcctcagcagccaccatcacccagctcgcagaagtggtcaagctgggggcagccagcctgggctccgacgaccccgagacccaggtggttttgatcaatgccatcaaagatgtggccaaggccctttctgatctcatcagtgctaccaagggagctgccagcaagccagtggacgacccttccatgtaccagctcaagggggctgccaaggtgatggtgaccaatgtcacctcgctcctcaagactgtaaaggcagtggaggatgaggccacccggggcaccagggcgcttgaggccacaattgaatgcataaagcaggagcttacggtgttccagtcaaaagacgtacctgaaaagacatcatcacctgaagaatccataaggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaggtcgccgcttccacggctcagctgctggtggcctgcaaggtgaaggccgaccaggattcagaggccatgaggcggctacaggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtggaatgctcgtctccttagcgtccagggtggggattctgctggaataaagagcttcctcagtgactcatctttaggtcccacgctggtttctgtgccttcagaatggtcacaagcccggattggaaaggatctgcttacaaacctgtcccctgtcctccaacccaaaacgcctttttttctgtcttaatatccagaaaatctaaatgcatcctaaaatcaatgtgaacctttaacaagatagttttacttattatcacataagacataagatgttttcattttctggatgtcacacttccagaatttcatatttttcccctcttttctttccccttttcagagccctcccataggaagggaagggcttgaatttacccttaatctgcacctttagccaaggcagtgcatggaagatgaatggctcgtgggacagaatctaatgccagggagcaggagtgtttgaaagaattcatagtggggaaggtaaaagttaatggaagtacatgattttcaaaactggtaacagttaaaggcactcaccctccgcctctctctctctctctctctctggtgtgctatcatgtcttggactccatccacactatagtttcaaagttccactgacgggggaaagttggtgctttggtcctccgaagatgtcacctttcgaccttgcccgatcttgtttcaccagactctagcccatgtcatggttttaaaatacataaacttctgacagcttcccatatttataagttacttataagtgctgcacgtattagaatttttttttttcagaccagtaaagttagagaaaagacgctgtaaaggaaaagcaagtgagagtatgtgtaggacactgacagtgtgtgggcaccagttctgaagaggaggggagctgctggagccctagcctgttggggaaaagctggcacactcttggctcgccctctttgagtggagctgatccaacacctcatgcctgccttggccggacactgagaggaggggcacacgtgcttccagagacactcaggagtcagaccccaatgctcagagtcacaatgtgttcatggcctcctgtaacaggactctggggatcccctctgtggcccagcccaccccaccctctgctcttctatgctgtgcccagggcagctgccctcttctgcctgtgccccatcccatcctgaaaacccaggaccaaggcaggggcaggcagccagttcttccaccttgcctcagagtcatttaaaacctttactgcatttgataccagaaaagcctccagagacaaaccaaatgcaaaggcctttcctttataactctaaagaacaggcatcgaaagtttatttttgtaggagctatataaatactcacctttctggagtcgtccagtgctgggagctttggggagtttggttctcagttatcacctggtatggtcccagtttctcatctgtcctttcctcatccaccctgcacatgtgtatgtgaacggcttcgtggccggtgtggtggtttctcatttcataagatagttgaagggccatgccttgtctggatgttatttaataggcactactgcggtgtcctcagatggtactgagggggccttctggtccttcaaaggaaaataacacaggcatgagttcatttgggagtgtgaactttcagaacacctaataagagagtggtgtcagagtaaaaacggccccaggtctggagcatagaagtgtatctctgtgaagagagagccggtgtgttgacatgtggttcttctcacacccctctactcctcgagggctttgaatccttgggctgatttttgtgccagaaattgctgttcccgatggccaaaaggggaacctgaactggatttcagaactgcccagtgatttgaaaatttagattttacttgggcctttcaggagtctttagatagggatgctgaggtcatatttagttcaatgaacagcccttgtttaagttttgccagtgtccagccagctgtggccctggccatctgtgcaggcaggttcctcaattcctggttggccctgcagtcggtcaacacagtccctccaggtcggctgcagaggcagctgcccagcctgcagtctatgcacgggccttaagaaatgagctgcctgtagcctcacggcatatgcttttatcagggaaaacccttcgagcttcttctgattctcacctgcttgctttctggctgtcttagtcagtgtgtttacaggcaactaaagcctgttcctaatttatcaaaaaattataaccaaaattcaccatagcctaagagagtaaaccccacctccaaagtgatgccaaggccaaaacctcatcaaggaaccagacacaggtcaaaagtggtgagcaagccatggtctctgctcctggggaactcacacgctgacccccgaggagccttggtttcctccctggcagatagtccccagaatcttctctcccagctttgaggttctgggctctggaaaggcctctgggatgctggccttaagatctcagcacagactatcagcatgttccattctcagattcctggaggaaaggtaccctctgttgaccaaggggctggctgcttctgagacttaccaacccaagaaatttggagacattcccctcaggctaaaaggcagcggtccccagagttcagaaagcaaaagatcttgacaactgtgccagtagtggctctggtcctatctctccacagtgctggcctctgctggggaaggcatctttcccaaaggtatccccaagtaccatgttgaaaatgtcctcagtctgttgctccatctttctgagcctctgcttggtatgtcatgtttatggtcactacggatgagtgtgtgcagagtttgggttgattcttttaaatgctacaaacaagagctatttcttttcaataaaaaaggtttggattcggcctcttcctctgagcccacctcccagccctccagggagcatcagtgtacctgagtcactttgtctgcatctcttcatcccacaaaacacgaggctgggtctcattcagcggcctctcaccaaccttcaagatccagaagaaaacaggaacgttcagctctgccctgtgtcgtatctaatcacatacattaatttatctaaccacataagttatttttttttatttgccagaaataaacctttaaaggaacaaa

SEQ ID NO: 30953 - DNA, 5795 bp, Homo sapiens
gcggcggcggcggcggtagcagcggcggcggcggcggggactggcatcggggccccgagccgagcggagccggaccccgggcgagcgcgtctgcagccaccccagctcatacctctctgcctccccgctctcaaggagggtctgccgcatgtgatgaaagtgtctactctcagggaaagctcagccatggcttccccactgccccgggagatggaggaggagctggtgcctactggctctgagccaggtgacactcgggccaaaccccctgtcaagcccaaaccccgggccctgcctgccaagccagccctgcctgccaaacccagcctgctggtgcctgttgggcctcggcctccccggggtcccctggctgagttgccttctgccaggaagatgaacatgctggcaggaccccagccctatggtggcagcaagcgcccccttccctttgcaccaaggcctgcggttgaggcctccactggaggagaagccacccaagagactgggaaagaggaggctgggaaagaggagccaccccctttgacacccccagctcgatgtgcagccccagggggtgtacggaaggcccctgcccctttccgcccagcctcagagcgcttcgcggccaccacggtggaagagatcctggccaagatggagcagcctcggaaggaggtccttgccagccccgaccgcctgtggggttcccgcctcacctttaaccacgatggcagctcgcgatatggccccaggacctatggcacgaccactgctcccagggatgaggatggcagcaccctcttcaggggatggtcccaggaggggccagtaaagtctccagcagagtgccgggaagagcacagcaagacccctgaggagaggagccttccttccgacctggccttcaacggggacctggctaaggcagccagctcggagctacctgctgatatttccaagccctggattccctcaagtccagccccctcctcagagaatggaggccctgccagcccaggcctccccgcagaagcctcaggctcaggccctggctctccccatcttcacccgcctgataagagttctccctgccactcacagcttctggaagcccagactcctgaagcttcccaggcttctccctgccccgctgtgactccatcagctccaagtgcagccctgcctgacgagggctcccgccacacccccagcccggggctccctgccgagggggctccagaggcccccagacccagcagcccaccccctgaggtcttggagccccatagcctggatcagccccctgccacctcaccccggcccctgatcgaggtgggtgagttgctggatctcactcggacgtttccatctggcggggaggaggaggccaagggtgacgcacacctccgccccaccagcctggttcagcgccgattctctgaaggtgtgctccagtcacccagtcaggaccaggagaagctggggggctcgctggctgccctgccccaaggccaggggagccagttggccctggatcgtccctttggggcagagtccaactggagcttatcacagtccttcgaatggaccttccccacgaggccctcgggtctgggcgtgtggcggctggactccccgcctccctcccccatcactgaagccagtgaggccgccgaggctgctgaggctggcaacttggccgtttccagcagggaagaaggagtgtctcagcaggggcaaggggctgggtcagctccaagtgggtcaggaagttcctgggtgcagggggatgatccaagcatgtccctcacccagaagggcgatggggagagtcaacctcaattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccagggagctgggggttggtgagacaagtgggccagagacccagggtgaagattactcctcgtcttccttggagccacaccctgcagaccctggaatggagacaggagaagccctcagcttcggagcaagccctggcaggtgcccggcccgccccccaccctccggctcccagggcctgctggaggagatgctggcagccagcagctccaaggcggtggctcggagggagtcagcggcctcgggccttgggggcctgttggaggaggaaggagccggggcaggtgctgcccaagaggaggtgctggagcctggcagggactctccaccctcctggaggccgcagcctgatggtgaggccagccagacagaagacgtggatggcacctggggctcttcagcagccaggtggagcgatcaggggccagcacagacttctcggcgaccctcccaaggccctcctgccagatcccccagtcaggacttctccttcattgaggacaccgagatcctcgacagtgccatgtatcggagccgtgccaacttggggcgcaagcgtgggcaccgggccccggtcattcggcctgggggtaccttgggcctgtcggaggcagcagactcggatgcacacctgttccaggactctacagagccacgggcatctcgggtgccatcttcagatgaagaggtagtggaggaacctcagagccgccggacacggatgtcgttgggcaccaaggggctgaaagtcaacctctttcctggcctgagcccctcagccctgaaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtcagaaggatcgtcgcccaactggcttcaagccctgaaactgaagaagaagaaggtctgagaagtcactgaggttcttcccacctggcagtctcaggcagtgcccattcctgtggggtccctgggtgaggagacggctggagccccaccatgccccaggctgcagcctctgtcccctccacctctgaggagcgtctggggaggcacatttatgcactttgtatcaccctccgaactccccccacaccttcccttccctggatttcatcactagtggttgaaggttttgtcccttcctctcctccttccctctccctctctgcttcctcctccagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaa

SEQ ID NO: 30954 - DNA, 594 bp, Homo sapiens
gtgattcacagacagacttcatactttgcagctctctagctctgctttgagtagacacctccagcggggccgtcctacccaaggggcactgtggggactgtctgcagccaccccagctcatacctctctgcctccccgctctcaaggagggtctgccgcatgtgatgaaagtgtctactctcagggaaagctcagccatggcttccccactgccccgggagatggaggaggagctggtgcctactggctctgagccaggtgacactcgggccaaaccccctgtcaagcccaaaccccgggccctgcctgccaagccagccctgcctgccaaacccagcctgctggtgcctgttgggcctcggcctccccggggtcccctggctgagttgccttctgccaggaagatgaacatgctggcaggaccccagccctatggtggcagcaagcgcccccttccctttgcaccaaggcctgcggttgaggcctccactggaggagaagccacccaagagactgggaaagaggaggctgggaaagaggagccaccccctttgacacccccagctcgatgtgcagccccagggggtgtacgga

SEQ ID NO: 30955 - DNA, 5952 bp, Homo sapiens
cagtgagtgactccctgaagcgctaggactttggggttaggagataagagttggggaggatctttgaagagttgaggatatggctgttgggaacctcccttgacctcctcctacccccccccccccactccaagttctctcttcctgtcccacactctgcctctgttagaaataggagacttctctctgctaaacctactggcaacgcccaactctttttttccttctcttctctctcttttcctaggtctgcagccaccccagctcatacctctctgcctccccgctctcaaggagggtctgccgcatgtgatgaaagtgtctactctcagggaaagctcagccatggcttccccactgccccgggagatggaggaggagctggtgcctactggctctgagccaggtgacactcgggccaaaccccctgtcaagcccaaaccccgggccctgcctgccaagccagccctgcctgccaaacccagcctgctggtgcctgttgggcctcggcctccccggggtcccctggctgagttgccttctgccaggaagatgaacatgctggcaggaccccagccctatggtggcagcaagcgcccccttccctttgcaccaaggcctgcggttgaggcctccactggaggagaagccacccaagagactgggaaagaggaggctgggaaagaggagccaccccctttgacacccccagctcgatgtgcagccccagggggtgtacggaaggcccctgcccctttccgcccagcctcagagcgcttcgcggccaccacggtggaagagatcctggccaagatggagcagcctcggaaggaggtccttgccagccccgaccgcctgtggggttcccgcctcacctttaaccacgatggcagctcgcgatatggccccaggacctatggcacgaccactgctcccagggatgaggatggcagcaccctcttcaggggatggtcccaggaggggccagtaaagtctccagcagagtgccgggaagagcacagcaagacccctgaggagaggagccttccttccgacctggccttcaacggggacctggctaaggcagccagctcggagctacctgctgatatttccaagccctggattccctcaagtccagccccctcctcagagaatggaggccctgccagcccaggcctccccgcagaagcctcaggctcaggccctggctctccccatcttcacccgcctgataagagttctccctgccactcacagcttctggaagcccagactcctgaagcttcccaggcttctccctgccccgctgtgactccatcagctccaagtgcagccctgcctgacgagggctcccgccacacccccagcccggggctccctgccgagggggctccagaggcccccagacccagcagcccaccccctgaggtcttggagccccatagcctggatcagccccctgccacctcaccccggcccctgatcgaggtgggtgagttgctggatctcactcggacgtttccatctggcggggaggaggaggccaagggtgacgcacacctccgccccaccagcctggttcagcgccgattctctgaaggtgtgctccagtcacccagtcaggaccaggagaagctggggggctcgctggctgccctgccccaaggccaggggagccagttggccctggatcgtccctttggggcagagtccaactggagcttatcacagtccttcgaatggaccttccccacgaggccctcgggtctgggcgtgtggcggctggactccccgcctccctcccccatcactgaagccagtgaggccgccgaggctgctgaggctggcaacttggccgtttccagcagggaagaaggagtgtctcagcaggggcaaggggctgggtcagctccaagtgggtcaggaagttcctgggtgcagggggatgatccaagcatgtccctcacccagaagggcgatggggagagtcaacctcaattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccagggagctgggggttggtgagacaagtgggccagagacccagggtgaagattactcctcgtcttccttggagccacaccctgcagaccctggaatggagacaggagaagccctcagcttcggagcaagccctggcaggtgcccggcccgccccccaccctccggctcccagggcctgctggaggagatgctggcagccagcagctccaaggcggtggctcggagggagtcagcggcctcgggccttgggggcctgttggaggaggaaggagccggggcaggtgctgcccaagaggaggtgctggagcctggcagggactctccaccctcctggaggccgcagcctgatggtgaggccagccagacagaagacgtggatggcacctggggctcttcagcagccaggtggagcgatcaggggccagcacagacttctcggcgaccctcccaaggccctcctgccagatcccccagtcaggacttctccttcattgaggacaccgagatcctcgacagtgccatgtatcggagccgtgccaacttggggcgcaagcgtgggcaccgggccccggtcattcggcctgggggtaccttgggcctgtcggaggcagcagactcggatgcacacctgttccaggactctacagagccacgggcatctcgggtgccatcttcagatgaagaggtagtggaggaacctcagagccgccggacacggatgtcgttgggcaccaaggggctgaaagtcaacctctttcctggcctgagcccctcagccctgaaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtcagaaggatcgtcgcccaactggcttcaagccctgaaactgaagaagaagaaggtctgagaagtcactgaggttcttcccacctggcagtctcaggcagtgcccattcctgtggggtccctgggtgaggagacggctggagccccaccatgccccaggctgcagcctctgtcccctccacctctgaggagcgtctggggaggcacatttatgcactttgtatcaccctccgaactccccccacaccttcccttccctggatttcatcactagtggttgaaggttttgtcccttcctctcctccttccctctccctctctgcttcctcctccagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttggg

SEQ ID NO: 30956 - DNA, 4662 bp, Homo sapiens
cccctcctcctcctcactcctcaccctccagggtagcggctaccggagcgctgcagggggctgcgcctgcctgctccgccccagacctgtcggcgaaaggtagtttatgccaacgtgacttcattcatacagatgaaccaaggatcgggatagcagtataaaattagaatcaagacagctgactgctcagcaggatgccatcaactaacagagcaggcagcctgaaggaccctgaaattgcagagctcttcttcaaagaagatccagagaagctcttcacagatctcagagaaattggccatggaagctttggagcagtgtattttgcacgagatgtgcgtaccaatgaagtggtggccatcaagaaaatgtcttatagtggaaagcagtctactgagaaatggcaggatattattaaggaagtcaagtttctacaaagaataaaacatcccaacagtatagaatacaaaggctgttatttacgtgaacacacagcatggcttgtaatggaatattgtttaggatctgcttcggatttactagaagttcacaaaaagccattacaagaagtggaaatagcagcaattacacatggtgctcttcagggattagcctacttacattctcatactatgattcatagagatatcaaagcaggaaatatccttctgacagaaccaggccaggtgaaacttgctgactttggctctgcttccatggcatcacctgccaattcctttgtgggaacgccgtattggatggccccagaagtaattttagccatggatgaaggacaatatgatggcaaagtagatgtgtggtctcttggaataacatgtattgaactagcggaaaggaagcctcctttatttaatatgaatgcaatgagtgccttatatcacatagcccaaaatgaatcccctacactacagtctaatgaatggtctgattattttcgcaactttgtagattcttgcctccagaaaatccctcaagatcgacctacatcagaggaacttttaaagcacatatttgttcttcgggagcgccctgaaaccgtgttaatagatctcattcagaggacaaaggatgcagtaagagagctggacaatctgcagtatcgaaagatgaagaaactccttttccaggaggcacataatggaccagcagtagaagcacaggaagaagaagaggaacaagatcatggtgttggccggacaggaacagttaatagtgttggaagtaatcaatccattcccagcatgtccatcagtgccagcagccaaagcagtagtgttaacagtcttccagatgtctcagatgacaagagtgagctagacatgatggagggagaccacacagtgatgtctaacagttctgttatccatttaaaaccagaggaagaaaattacagagaagagggagatcctagaacaagagcatcagatccacaatctccaccccaagtatctcgtcacaaatcacactatcgtaatcgagaacactttgctactatacggacagcatcactggttacgaggcaaatgcaagaacatgagcaggactctgagcttagagaacaaatgtctggctataagcgaatgaggcgacaacatcaaaagcaactgatgactctggaaaacaagctaaaggctgagatggatgaacatcgcctcagattagacaaagatcttgaaactcagcgtaacaattttgctgcagaaatggagaaacttatcaagaaacaccaggctgccatggagaaagaggctaaagtgatgtccaatgaagagaaaaaatttcagcaacatattcaggcccaacagaagaaagaactgaatagttttctcgagtcccagaaaagagagtataaacttcgaaaagagcagcttaaagaggagctaaatgaaaaccagagtacccccaaaaaagaaaaacaggagtggctttcaaagcagaaggagaatatacagcatttccaagcagaagaagaagctaaccttcttcgacgtcaaagacaatacctagagctggaatgccgtcgcttcaagagaagaatgttacttgggcgtcataacttagagcaggaccttgtcagggaggagttaaacaaaagacagactcagaaggacttagagcatgccatgctactccgacagcatgaatctatgcaagaactggagttccgccacctcaacacaattcagaagatgcgctgtgagttgatcagattacagcatcaaactgagctcactaaccagctggaatataataagcgaagagaacgagaactaagacgaaagcatgtcatggaagttcgacaacagcctaagagtttgaagtctaaagaactccaaataaaaaagcagtttcaggatacctgcaaaatccaaaccagacagtacaaagcattaagaaatcacctgctggagactacaccaaagagtgagcacaaagctgttctgaaacggctcaaggaggaacagacccggaaattagctatcttggctgagcagtatgatcacagcattaatgaaatgctctccacacaagccctgcgtttggatgaagcacaggaagcagagtgccaggttttgaagatgcagctgcagcaggaactggagctgttgaatgcgtatcagagcaaaatcaagatgcaagctgaggcacaacatgatcgagagcttcgcgagcttgaacagagggtctccctccggagggcactcttagaacaaaagattgaagaagagatgttggctttgcagaatgagcgcacagaacgaatacgaagcctgttggaacgtcaagccagagagattgaagcttttgactctgaaagcatgagactaggttttagtaatatggtcctttctaatctctcccctgaggcattcagccacagctacccgggagcttctggttggtcacacaaccctactgggggtccaggacctcactggggtcatcccatgggtggcccaccacaagcttggggccatccaatgcaaggtggaccccagccatggggtcacccttcagggccaatgcaaggggtacctcgaggtagcagtatgggagtccgcaatagcccccaggctctgaggcggacagcttctgggggacggacggagcagggcatgagcagaagcacgagtgtcacttcacaaatatccaatgggtcacacatgtcttatacataacttaataattgagagtggcaattccgctggagctgtctgccaaaagaaactgcctacagacatcatcacagcagcctcctcacttgggtactacagtgtggaagctgagtgcatatggtatattttattcatttttgtaaagcgttctgttttgtgtttactaattgggatgtcatagtacttggctgccgggtttgtttgtttttggggaaattttgaaaagtggagttgatattaaaaataaatgtgtatgtgtgtacatatatatacacacacatacacatatattatgcatgtggtgaaaagaattggctagataggggatttttctgaacactgcaaaaatagaacgtagcaaaatggcttcagttatcacttttgggtgtctgtatcctaagaagtttctgaaaagatctaaagcctttttatcccatatcccaaattcttatgagccactcacagcaggcagcatatgttgaaataagttattactggtacacacctgcattgcctcaccagtgtatttatttgttattaaattgatctgacttctcagcctcatttggactaaaaaaagaaagcagaaatccatgaacacattgcttctcggccttttggctaagatcaagtgtagaaatccatgaacactaaaggacttcattgattttttcagagagtagaaaacaacttagtttttcttttttcctgaatgcgtcataggcttgtgagtgatttttgtccattcaattgtgccttctttgtattatgataagatgggggtacttaaggagatcacaagttgtgtgaggattgcattaacaaacctatgagccttcaatggggaagaccagaagggtgagaggggccctgaaagttcatatggtgggtatgtcccgcagcagagtgaggagatgaagcttacgtgtcctgacgttttgttgcttatactgtgatatctcatcctagctaagctctataatgcccaagaccccaaacagtacttttactttgtttgtacaaaaacaaagacatatagccaatacaaatcaaatgccggaggtgtttgatgccatatttgcaaattgccatctattgaaattctcgtcacactacatagacataattgttatctccttttggcttatgtgattttctgtttacaagtagaatagccaattatttaaatgtttagttgccacagtgaaccaggagtcactgagccaatgactttaccagctgctgactaatcttcatcaccactgtagattttgctgcatgtgcaggtcctctatttttaattgctgttttcgttgctgcagtactttacaaacttctagttcgttgagacttagtgaccatttggcatcaagttaacatcacacaataggaaacaccacttccacaagtctcaagcctcagtgctaaagtactactgaaaaggaactaggaagtttggccaatt

SEQ ID NO: 30957 - DNA, 4068 bp, Homo sapiens
ctcctcctcactcctcaccctccagggtagcggctaccggagcgctgcagggggctgcgcctgcctgctccgccccagacctgtcggcgaaaggtagtttatgccaacgtgacttcattcatacagatgaaccaaggatcgggatagcagtataaaattagaatcaagacagctgactgctcagcaggatgccatcaactaacagagcaggcagcctgaaggaccctgaaattgcagagctcttcttcaaagaagatccagagaagctcttcacagatctcagagaaattggccatggaagctttggagcagtgtattttgcacgagatgtgcgtaccaatgaagtggtggccatcaagaaaatgtcttatagtggaaagcagtctactgagaaatggcaggatattattaaggaagtcaagtttctacaaagaataaaacatcccaacagtatagaatacaaaggctgttatttacgtgaacacacagcatggcttgtaatggaatattgtttaggatctgcttcggatttactagaagttcacaaaaagccattacaagaagtggaaatagcagcaattacacatggtgctcttcagggattagcctacttacattctcatactatgattcatagagatatcaaagcaggaaatatccttctgacagaaccaggccaggtgaaacttgctgactttggctctgcttccatggcatcacctgccaattcctttgtgggaacgccgtattggatggccccagaagtaattttagccatggatgaaggacaatatgatggcaaagtagatgtgtggtctcttggaataacatgtattgaactagcggaaaggaagcctcctttatttaatatgaatgcaatgagtgccttatatcacatagcccaaaatgaatcccctacactacagtctaatgaatggtctgattattttcgcaactttgtagattcttgcctccagaaaatccctcaagatcgacctacatcagaggaacttttaaagcacatatttgttcttcgggagcgccctgaaaccgtgttaatagatctcattcagaggacaaaggatgcagtaagagagctggacaatctgcagtatcgaaagatgaagaaactccttttccaggaggcacataatggaccagcagtagaagcacaggaagaagaagaggaacaagatcatggtgttggccggacaggaacagttaatagtgttggaagtaatcaatccattcccagcatgtccatcagtgccagcagccaaagcagtagtgttaacagtcttccagatgtctcagatgacaagagtgagctagacatgatggagggagaccacacagtgatgtctaacagttctgttatccatttaaaaccagaggaagaaaattacagagaagagggagatcctagaacaagagcatcagatccacaatctccaccccaagtatctcgtcacaaatcacactatcgtaatcgagaacactttgctactatacggacagcatcactggttacgaggcaaatgcaagaacatgagcaggactctgagcttagagaacaaatgtctggctataagcgaatgaggcgacaacatcaaaagcaactgatgactctggaaaacaagctaaaggctgagatggatgaacatcgcctcagattagacaaagatcttgaaactcagcgtaacaattttgctgcagaaatggagaaacttatcaagaaacaccaggctgccatggagaaagaggctaaagtgatgtccaatgaagagaaaaaatttcagcaacatattcaggcccaacagaagaaagaactgaatagttttctcgagtcccagaaaagagagtataaacttcgaaaagagcagcttaaagagtctaaagaactccaaataaaaaagcagtttcaggatacctgcaaaatccaaaccagacagtacaaagcattaagaaatcacctgctggagactacaccaaagagtgagcacaaagctgttctgaaacggctcaaggaggaacagacccggaaattagctatcttggctgagcagtatgatcacagcattaatgaaatgctctccacacaagccctgcgtttggatgaagcacaggaagcagagtgccaggttttgaagatgcagctgcagcaggaactggagctgttgaatgcgtatcagagcaaaatcaagatgcaagctgaggcacaacatgatcgagagcttcgcgagcttgaacagagggtctccctccggagggcactcttagaacaaaagattgaagaagagatgttggctttgcagaatgagcgcacagaacgaatacgaagcctgttggaacgtcaagccagagagattgaagcttttgactctgaaagcatgagactaggttttagtaatatggtcctttctaatctctcccctgaggcattcagccacagctacccgggagcttctggttggtcacacaaccctactgggggtccaggacctcactggggtcatcccatgggtggcccaccacaagcttggggccatccaatgcaaggtggaccccagccatggggtcacccttcagggccaatgcaaggggtacctcgaggtagcagtatgggagtccgcaatagcccccaggctctgaggcggacagcttctgggggacggacggagcagggcatgagcagaagcacgagtgtcacttcacaaatatccaatgggtcacacatgtcttatacataacttaataattgagagtggcaattccgctggagctgtctgccaaaagaaactgcctacagacatcatcacagcagcctcctcacttgggtactacagtgtggaagctgagtgcatatggtatattttattcatttttgtaaagcgttctgttttgtgtttactaattgggatgtcatagtacttggctgccgggtttgtttgtttttggggaaattttgaaaagtggagttgatattaaaaataaatgtgtatgtgtgtacatatatatacacacacatacacatatattatgcatgtggtgaaaagaattggctagataggggatttttctgaacactgcaaaaatagaacgtagcaaaatggcttcagttatcacttttgggtgtctgtatcctaagaagtttctgaaaagatctaaagcctttttatcccatatcccaaattcttatgagccactcacagcaggcagcatatgttgaaataagttattactggtacacacctgcattgcctcaccagtgtatttatttgttattaaattgatctgacttctcagcctcatttggactaaaaaaagaaagcagaaatccatgaacacattgcttctcggccttttggctaagatcaagtgtagaaatccatgaacactaaaggacttcattgattttttcagagagtagaaaacaacttagtttttcttttttcctgaatgcgtcataggcttgtgagtgatttttgtccattcaattgtgccttctttgtattatgataagatgggggtacttaaggagatcacaagttgtgtgaggattgcattaacaaacctatgagccttcaatggggaagaccagaagggtgagaggggccctgaaagttcatatggtgggtatgtcccgcagcagagtgaggagatgaagcttacgtgtcctgacgttttgttgcttatactgtgatatctcatcctagctaagctctataatgcccaagaccccaaacagtacttttactttgtttgtacaaaaacaaagacatatagccaatacaaatcaaatgccggaggtgtttgatgccatatttgcaaattgccatctattgaaattctcgtcacactacatagacataattgttatctccttttggcttatgtgattttctgtttacaagtagaatagccaattatttaaatgtttagttgccacagtgaaccaggagtcactgagccaatgactttaccagctgctgactaatcttcatcaccactgtagattttgctgcatgtgcaggtcctctatttttaattgctgttttcgttgctgca

SEQ ID NO: 30958 - DNA, 4246 bp, Homo sapiens
agaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaatctaaggagctgcagatcaagaagcagttccaggagacgtgtaagatccagactcggcagtacaaggctctgcgagcacacttgctggagaccacgcccaaagctcagcacaagagcctccttaagcggctcaaggaagagcagacccgcaagctggcgatcttggcggagcagtatgaccagtccatctcagagatgctcagctcacaggcgctgcggcttgatgagacccaggaggcagagttccaggcccttcggcagcagcttcaacaggagctggagctgctcaacgcttaccagagcaagatcaagatccgcacagagagccagcacgagagggagctgcgggagctggagcagagggtcgcgctgcggcgggcactgctggagcagcgggtggaagaggagctgctggccctgcagacaggacgctccgagcgaatccgcagtctgcttgagcggcaggcccgtgagatcgaggccttcgatgcggaaagcatgaggctgggcttctccagcatggctctggggggcatcccggctgaagctgctgcccagggctatcctgctccaccccctgccccagcctggccctcccgtcccgttccccgttctggggcacactggagccatggccctcctccaccaggcatgccccctccagcctggcgtcagccgtctctgctggctcccccaggccccccaaactggctggggccccccacacaaagtgggacaccccgtggcggagccctgctgctgctaagaaacagcccccagcccctgcggcgggcagcctcggggggcagtggcagtgagaatgtgggcccccctgctgccgcggtgcccgggcccctgagccgcagcaccagtgtcgcttcccacatcctcaatggttcttcccacttctattcctgaggtgcagcggggaggagcagatgagctgggcagggcaggggtgggtggagcctgaccctggagggcactgagctggaggcccctgcaagggtaggggacaagatgtaggctccagctcccctcagacctcctcatctcatgagcttcttggggctggccagtggcccagggccagcttggcgataggtgcctcaaggctgcctgggagccccgcctccctaccatggtgccaggggtctccctccgccacctaggaaaggagggagatgtgcgtgtcaaatattcatctagtcccctgggggaggggaagggtgggtctagacatactatattcagagaactatactaccctcacagtgaggccctcagacctgccacagggcagagcaggtctggggcctgaggcagggagaatgagaggccaccttactggcaggaaggatcaggatggggtcttggggtcaggatgcctgggtctcttcccgtaactgtctgacgtcctgtgccgtcttgtcctttatctttttttttttttttttaattgggatcagggctggggcggggaaacaagggaaggaccttggaaggggctgctcccaggcctggggggcagtcgtgggagcccctctcagctgtggggctggcacagagccccaggcaagcttttaataaactgttggttattctaacaga

SEQ ID NO: 30959 - DNA, 4871 bp, Homo sapiens
gctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaactgtg

SEQ ID NO: 30960 - DNA, 3048 bp, Homo sapiens
gagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaaaaaaagacaaacacaaataaaatatctgagcgg

SEQ ID NO: 30961 - DNA, 4072 bp, Homo sapiens
tgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctgg

SEQ ID NO: 30962 - DNA, 3684 bp, Homo sapiens
ccaggagggcgcggtaaggctggggtatcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggctaaatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtagagatggggtttcaccatgttggccaggctgctctcgaactcctgacctcagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttgagactgagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaa

SEQ ID NO: 30963 - DNA, 3766 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtatcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggctaaatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttgagactgagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaa

SEQ ID NO: 30964 - DNA, 1824 bp, Homo sapiens
ctggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaa

SEQ ID NO: 30965 - DNA, 3759 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaacttttttttttttttttttgagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggactggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaa

SEQ ID NO: 30966 - DNA, 3677 bp, Homo sapiens
ccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtagagatggggtttcaccatgttggccaggctgctctcgaactcctgacctcagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaacttttttttttttttttttgagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggactggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaa

SEQ ID NO: 30967 - DNA, 1824 bp, Homo sapiens
ctggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaa

SEQ ID NO: 30968 - DNA, 3766 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtatcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttctttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaacttttttttttttttttttgagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaa

SEQ ID NO: 30969 - DNA, 1824 bp, Homo sapiens
ctggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggctaaatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaa

SEQ ID NO: 30970 - DNA, 3684 bp, Homo sapiens
ccaggagggcgcggtaaggctggggtatcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtagagatggggtttcaccatgttggccaggctgctctcgaactcctgacctcagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttctttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaacttttttttttttttttttgagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaa

SEQ ID NO: 30971 - DNA, 3766 bp, Homo sapiens; identical to SEQ ID NO: 30963

SEQ ID NO: 30972 - DNA, 1888 bp, Homo sapiens
ctggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaattaacttaataatataccttatttaatctaataattctggtcccttatctgaaatgcttgggtc

SEQ ID NO: 30973 - DNA, 612 bp, Homo sapiens
gcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtaca

SEQ ID NO: 30974 - DNA, 3759 bp, Homo sapiens; identical to SEQ ID NO: 30965

SEQ ID NO: 30975 - DNA, 3684 bp, Homo sapiens; identical to SEQ ID NO: 30962

SEQ ID NO: 30976 - DNA, 612 bp, Homo sapiens
gcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtaca

SEQ ID NO: 30977 - DNA, 612 bp, Homo sapiens; identical to SEQ ID NO: 30973

SEQ ID NO: 30978 - DNA, 612 bp, Homo sapiens; identical to SEQ ID NO: 30973

SEQ ID NO: 30979 - DNA, 1693 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagcatgctacttaa

SEQ ID NO: 30980 - DNA, 1824 bp, Homo sapiens; identical to SEQ ID NO: 30969

SEQ ID NO: 30981 - DNA, 817 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcatggggcacgctatgcctgtcgaattcaccatcccagcctgcctgcctcggggcgcagcgctgaggtcaccctggaggtag

SEQ ID NO: 30982 - DNA, 1686 bp, Homo sapiens
ccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtagagatggggtttcaccatgttggccaggctgctctcgaactcctgacctcagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataata

SEQ ID NO: 30983 - DNA, 1299 bp, Homo sapiens
agtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtga

SEQ ID NO: 30984 - DNA, 1693 bp, Homo sapiens; identical to SEQ ID NO: 30979

SEQ ID NO: 30985 - DNA, 2884 bp, Homo sapiens
ggcgcggtaaggctggggtatcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttctttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaacttttttttttttttttttgagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttcc

SEQ ID NO: 30986 - DNA, 1404 bp, Homo sapiens
ggagtaatggttttcgggcaagtggatgttggagagcacacacaggagttggggggcgggggagggcctggggttggggagggctcgaactcggggctgctgggtagtccaggagggcgcggtaaggctggggtatcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagcatgctacttaa

SEQ ID NO: 30987 - DNA, 1665 bp, Homo sapiens
ggagtaatggttttcgggcaagtggatgttggagagcacacacaggagttggggggcgggggagggcctggggttggggagggctcgaactcggggctgctgggtagtccaggagggcgcggtaaggctggggtatcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggctaaatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagcatgctacttaa

SEQ ID NO: 30988 - DNA, 1404 bp, Homo sapiens
ggagtaatggttttcgggcaagtggatgttggagagcacacacaggagttggggggcgggggagggcctggggttggggagggctcgaactcggggctgctgggtagtccaggagggcgcggtaaggctggggtatcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggctaaatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagcatgctacttaa

SEQ ID NO: 30989 - DNA, 817 bp, Homo sapiens; identical to SEQ ID NO: 30981

SEQ ID NO: 30990 - DNA, 1665 bp, Homo sapiens
ggagtaatggttttcgggcaagtggatgttggagagcacacacaggagttggggggcgggggagggcctggggttggggagggctcgaactcggggctgctgggtagtccaggagggcgcggtaaggctggggtatcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagcatgctacttaa

SEQ ID NO: 30991 - DNA, 3495 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaacttttttttttttttttttgagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggactggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttcc

SEQ ID NO: 30992 - DNA, 1665 bp, Homo sapiens; identical to SEQ ID NO: 30987

SEQ ID NO: 30993 - DNA, 1404 bp, Homo sapiens; identical to SEQ ID NO: 30988

SEQ ID NO: 30994 - DNA, 2532 bp, Homo sapiens
atgctgctggaggccgagcggcggcgcggcgggggcgcggcgggggcgcggctgctggagcggtaccgccgcgtgcctggcgtgcgcgccctccgcgccgacagcgtcctcatcatcgagacggtgcccggcttcccgcccgcgccgcccgccccgggggccgcgcagatccgcgccgccgaggtgctggtgtacggggcgccgcccggccgcgtcagccgcctactggagaggttcgacccgcccgccgcgccgcgccgccgcgggagccccgagcgcgcccgccccccgccgccgccgccgccgcccgcgccgccccggcccccgcccgcggcccccagcccgcccgccgcgcccgggccccgcggtggcggggcgagccccggggcccggcgcagcgacttcctccagaagaccggcagcaactccttcaccgtccacccccggggtctgcaccgcggcgcgggcgcccgcctgctctccaacgggcactcggcccctgagccccgggccggccctgccaaccgcctcgcgggctccccgcctgggtcgggacagtggaagccaaaggtggagtcgggggatccctccctccacccgccccccagccccgggaccccgagtgccactccagcctcaccccctgccagtgccactcctagccagcgccagtgcgtctccgcagccaccagcaccaacgactccttcgagatacggccggcccccaagccagttatggagaccatccccttgggggacctccaggcccgggcgctggccagcctccgcgcaaactctcgaaattctttcatggtcatccccaagagcaaggcctccggggctcctcctcctgaggggaggcagtccgtggagctgccaaagggagacctgggcccggcctccccgagccaggagctcggatcccagccggtgcctggaggggatggtgcgcctgccctcgggaagagccccctggaggtcgaggcacagtgggcagtcgaggagggggcctgtcccaggacagccaccgccctcgctgaccgggctattaggtggcagaggccgtcctcaccgccccccttcctgccggctgcttcggaagaagctgagcctgctgagggcctcagggttcctggcttggccaagaatagccgggaatatgtgaggccggggctgcctgtcaccttcatcgatgaggtagactcggaggaggccccccaagcagccaaactaccctacctcccgcaccctgccaggcctctgcaccctgccaggcccgggtgcgtggcagagcttcagccccggggcagcaacaccttcacagtggtgcccaagaggaagccagggactctgcaggaccagcacttcagtcaggccaacagggagcctcggccacgggaggccgaggaggaggaggctagttgcctcctggggcccacgttgaagaagcgctaccccaccgtgcatgagatcgaggtgattggcggctacctggccctgcagaagtcctgcctcaccaaggctggctcctcaagaaagaagatgaagatctccttcaacgacaaaagcctgcagaccacatttgagtacccttccgagagctccctagagcaggaggaagaggtggaccagcaggaggaggaggaggaggaggaggaggaagaggaagaggaggaagagggatccggctcagaggagaagccctttgcactcttcctgccccgggccacgtttgtgagcagcgtgagacccgagagctctcggctgccagagggtagctcaggcctgtccagctacaccccgaagcactctgtggccttcagcaagtggcaggagcaggcgctggagcaggccccgagggaggcagagcccccgcccgtggaggccatggtgagatgcgggggagtggagcgctggggggagtctgacacccgggcgagcccatgtgtccacattctgtcctctcactttcagctcacacccgccagtcagaatgacctctcggacttccgcagcgagccagccctgtatttctgagcccagcactgccaggaccaaggctgagcccagctgtgggagtcccggaagctgggcagtagccagggactactgcacccgcttctgccttgtttggcctcactgtatcccacccacccctcctggccctggaagcagctagggtgcctcctgccatcggggccaggtctgggtctcactccccggccctgatttgggagggtccaagggggaagtggggtggggaactgcctgtgggtgagtgccaggggcctgctgggtggtggccatctgcgacccggcagggggctgtgcagattctgcacctggccattccctgtcctgtctcctcagcctgcctcacagtggccatggggtgtcggggtgaagggctgtcccagctacttgtcctctgcaggaccctaagcccctgcccgcagcccacatgccctctgtgatgagtggcgtctttcctgcctctgatgatggactcaataaacagcactggacaaggct

SEQ ID NO: 30995 - DNA, 2718 bp, Homo sapiens
gggggcgtggccgcggcgcccaggctggccgcggcggcggctgccactccggccctcagtccagccgtccgctgccgcgttcgcagcatggccgccctggggcggccgggctcggggccgcgcgctgcggtgcccgcttggaagcgtgagatcctggagcggaagcgggccaagctagccgcgctgggcgggggcgcggggcccggggcggcggagcccgagcagcgggtgctggccgagagcctgggcccgctgcgcgagaacccgttcatgctgctggaggccgagcggcggcgcggcgggggcgcggcgggggcgcggctgctggagcggtaccgccgcgtgcctggcgtgcgcgccctccgcgccgacagcgtcctcatcatcgagacggtgcccggcttcccgcccgcgccgcccgccccgggggccgcgcagatccgcgccgccgaggtgctggtgtacggggcgccgcccggccgcgtcagccgcctactggagaggttcgacccgcccgccgcgccgcgccgccgcgggagccccgagcgcgcccgccccccgccgccgccgccgccgcccgcgccgccccggcccccgcccgcggcccccagcccgcccgccgcgcccgggccccgcggtggcggggcgagccccggggcccggcgcagcgacttcctccagaagaccggcagcaactccttcaccgtccacccccggggtctgcaccgcggcgcgggcgcccgcctgctctccaacgggcactcggcccctgagccccgggccggccctgccaaccgcctcgcgggctccccgcctgggtcgggacagtggaagccaaaggtggagtcgggggatccctccctccacccgccccccagccccgggaccccgagtgccactccagcctcaccccctgccagtgccactcctagccagcgccagtgcgtctccgcagccaccagcaccaacgactccttcgagatacggccggcccccaagccagttatggagaccatccccttgggggacctccaggcccgggcgctggccagcctccgcgcaaactctcgaaattctttcatggtcatccccaagagcaaggcctccggggctcctcctcctgaggggaggcagtccgtggagctgccaaagggagacctgggcccggcctccccgagccaggagctcggatcccagccggtgcctggaggggatggtgcgcctgccctcgggaagagccccctggaggtcgaggcacagtgggcagtcgaggagggggcctgtcccaggacagccaccgccctcgctgaccgggctattaggtggcagaggccgtcctcaccgccccccttcctgccggctgcttcggaagaagctgagcctgctgagggcctcagggttcctggcttggccaagaatagccgggaatatgtgaggccggggctgcctgtcaccttcatcgatgaggtagactcggaggaggccccccaagcagccaaactaccctacctcccgcaccctgccaggcctctgcaccctgccaggcccgggtgcgtggcagagcttcagccccggggcagcaacaccttcacagtggtgcccaagaggaagccagggactctgcaggaccagcacttcagtcaggccaacagggagcctcggccacgggaggccgaggaggaggaggctagttgcctcctggggcccacgttgaagaagcgctaccccaccgtgcatgagatcgaggtgattggcggctacctggccctgcagaagtcctgcctcaccaaggctggctcctcaagaaagaagatgaagatctccttcaacgacaaaagcctgcagaccacatttgagtacccttccgagagctccctagagcaggaggaagaggtggaccagcaggaggaggaggaggaggaggaggaggaagaggaagaggaggaagagggatccggctcagaggagaagccctttgcactcttcctgccccgggccacgtttgtgagcagcgtgagacccgagagctctcggctgccagagggtagctcaggcctgtccagctacaccccgaagcactctgtggccttcagcaagtggcaggagcaggcgctggagcaggccccgagggaggcagagcccccgcccgtggaggccatgctcacacccgccagtcagaatgacctctcggacttccgcagcgagccagccctgtatttctgagcccagcactgccaggaccaaggctgagcccagctgtgggagtcccggaagctgggcagtagccagggactactgcacccgcttctgccttgtttggcctcactgtatcccacccacccctcctggccctggaagcagctagggtgcctcctgccatcggggccaggtctgggtctcactccccggccctgatttgggagggtccaagggggaagtggggtggggaactgcctgtgggtgagtgccaggggcctgctgggtggtggccatctgcgacccggcagggggctgtgcagattctgcacctggccattccctgtcctgtctcctcagcctgcctcacagtggccatggggtgtcggggtgaagggctgtcccagctacttgtcctctgcaggaccctaagcccctgcccgcagcccacatgccctctgtgatgagtggcgtctttcctgcctctgatgatggactcaataaacagcactggacaaggct

SEQ ID NO: 30996 - DNA, 5130 bp, Homo sapiens
atggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggaccccagtctgcagcctcgccaccgccggcgcgtgctgagggcggcgggcgcggccctgcgctcgtgcgtccgcctggccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgcgtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggcccaagtctgttttggtggtctgagaggaaaaaagatgagcttctaaagttttgggaaaattatattttaattatggagactttagaaggaaatcagatacatgttataaagccagttttaccaaagctaaacaatctgtttgaatatgcggtgtcagaggaaaatggatgttggctctttcacccatcctggcatatgtgtatttataaaagaatgtttgaaagtgaaaacaaaatcctgtccaaagaaggtgttatccattttttggagctgtatgaaacaaagattcttccattttcaccagaattttctgagtttattattggaccattaatggatgcgctttcagagagctctctgtatagcaggtccccaggccagccaataggaagctgttctccattgggactgaaattacagaagtttttagtcacttatatttctcttcttccagaagaaataaagagtagcttcctattgaagtttattcggaagatgacaagtaggcattggtgtgctgttcccattttgtttctatctaaggctttggcaaatgtcccaagacataaggccctgggtatagatgggcttcttgctctcagggatgttattcattgcactatgatcacacatcagattctcctgagaggggcagcccaatgctaccttcttcaaacagctatgaatttgctagatgtggagaaagtgtcactttctgatgtctcaacttttctcatgtctctgagacaagaggaatccttaggacgaggaacttcattgtggacagagctgtgtgactggctacgtgttaatgaaagctattttaagccatcccctacgtgtagctccattggacttcacaagacatctttaaatgcttatgtaaagagcattgttcaagagtatgttaagtcatctgcttgggaaacaggagaaaactgctttatgcctgattggtttgaagccaagcttgtttctctgatggtcttgctggctgtggatgtggaaggaatgaagactcagtatagcggaaagcagagaacagagaatgtattgcggatattcttagaccctcttctggatgtgcttatgaagtttagtaccaatgcctacatgcccttgctgaagactgacagatgcctccagctgctgttgaagctgttgaacacatgcaggttgaaaggttccagtgcccaagatgatgaggtgtctactgttcttcagaactttttcatgtctactacagagagcatttctgaatttattctcagaagacttactatgaatgagctaaatagtgtttcagatctggatcgttgccatttatacctgatggtgttaactgagcttataaatctgcatttgaaggttgggtggaaaaggggtaaccctatctggagagttatttctcttttgaaaaatgcatccattcagcatcttcaagagatggacagtggacaggagccaacagttggaagtcagattcagagagtagtgagcatggctgccttggccatggtgtgtgaggccatagaccagaagcctgagctgcagctggactctctccatgctgggcccctggaaagcttcctttcctctcttcagctcaatcagacgctgcagaagccccacgcagaggagcagagcagttatgctcaccccttggagtgcagcagtgttttggaagaatcgtcatcttcccaaggatggggaaaaatagttgcacaatatattcatgatcaatgggtgtgcctctctttcctgttgaaaaaatatcacacccttataccaaccacagggagtgaaattctggaaccgtttctacctgccgttcagatgccaataaggactttgcagtctgcactagaagccctcacagttctttcttctgatcaagttttaccagtgttccattgcttgaaagtgttggttcccaagcttctgacttcctctgaatcactctgcatagagtcttttgacatggcgtggaaaattatatcttctttaagcaacactcagctgatattctgggctaatttaaaagcttttgttcagtttgtttttgataacaaagttcttaccattgctgccaaaatcaagggccaggcatatttcaaaataaaagagattatgtacaagataattgaaatgtctgctataaagactggagtcttcaatacactgataagttactgctgtcagtcttggatagtgtctgcttcaaatgtgtcccaaggatctttatcaagtgctaaaaattatagcgaacttatccttgaggcttgtatatttggaactgtgtttaggcgtgatcaaagacttgttcaggatgtacagaccttcatagaaaaccttggacatgactgtgcggcaaatattgttatggaaaatactaagagagaagaccattatgtgagaatttgtgctgtcaaattcctgtgtttattagatggctccaatatgtcccacaagttgtttattgaggatcttgcaatcaagctattagataaagatgaattagtgtccaagtccaaaaaacgctactatgtgaattctctacagcacagagtgaaaaaccgagtgtggcagactctgctggtacttttccctagacttgaccagaatttcttgaatggaattattgacaggattttccaggctggtttcaccaacaatcaagcatccataaaatattttatagaatggattattatattgattcttcataaattccctcaatttcttccaaagttctgggattgtttttcttatggtgaagaaaatcttaaaacaagcatttgtacgtttttagcagttttatcacatttagacattattactcaaaatattccagaaaagaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagagaccatattttacatccttccacgcctttcaggccttattgaagatgaatggatcaccattgataaatttaccagattcactgatgttcctttagctgcgggatttcagtggtacctttctcaaactcaacttagtaaactaaaaccaggtgactggtctcagcaagacataggtactaatttggtcgaagcagataaccaagcggagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcagcacctcagtgtctctgcagaacagtggcttcctctagtggaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaaacaatggattttttaagagagaa

SEQ ID NO: 30997 - DNA, 1867 bp, Homo sapiens
tccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttttaa

SEQ ID NO: 30998 - DNA, 1368 bp, Homo sapiens
gctcttgggttctgtagttttctcgcgatccaaaaggctccgtgcccaaagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtgga

SEQ ID NO: 30999 - DNA, 1402 bp, Homo sapiens
ctgcctccagctctaaatagtttggggttggcccggttcccagactgcactggaacactgggctttatgcccccacattcagtgcatttgtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatg

SEQ ID NO: 31000 - DNA, 2748 bp, Homo sapiens
ggccctagcgccattttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataa

SEQ ID NO: 31001 - DNA, 1835 bp, Homo sapiens
gaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtgttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttatttgaaaagtt

SEQ ID NO: 31002 - DNA, 1357 bp, Homo sapiens
gcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaag

SEQ ID NO: 31003 - DNA, 2389 bp, Homo sapiens
cgctcttacaccctgggcagcctcctccgatggcccactccccgcctctttcactttctggagatcactgagctctccatcctctctgggaatttaccgatgcccagaacgcccttctttcccccacacgaccctctcctagtctaactcctgggcgtgctttaagctcagctcaggcagcgtcaccttctctggaaagcccaaacccagccaccccactacccgctacccgcggcccacgctgatgaagacagcagaacacggaggccccgcgttcccgccgcgagagcaggagagaaagattacctcccgcgagctctagcgcgcccggctttccggcgcactccagggggcgtggctcgggtccacccgggctgcgagccggcagcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatggccgccgacagtgacgatggcgcagtttcagctcccgcagcttccgacggtggtgtcagcaaaagcacaacatctggggaggagctagtagtccaggttcccgtagtggatgtgcaaagcaacaacttcaaggagatgtggccatccctcctgctagccataaagacagctaatttcgtggctgtggacacggagctgagtgggcttggggacaggaagagtttgctgaaccagtgcattgaggaacgttacaaggccgtgtgtcatgctgccaggacccgttctatcctttccctgggcctcgcctgcttcaagcggcagccagacaagggtgaacattcctatctggctcaagtgttcaatctcactctgctgtgcatggaggagtatgtcatagaaccaaagtctgtgcagttcctgatacagcatggcttcaacttcaaccagcagtatgcccaaggcatcccctaccataagggcaatgacaagggtgatgagagccagagccagtcagtacggaccctattcctggagctaatccgagcccgccggcccctggtgctacacaatggccttatagacttggtgttcctgtaccagaacttctatgcacacctccctgagagtctgggaaccttcaccgctgacctgtgtgagatgttcccagcaggcatttatgacaccaaatatgctgctgagtttcatgcccgtttcgtggcctcctacttagaatatgccttccggaaatgtgaacgggaaaatgggaagcagcgggcagctggcagcccacaccttaccctggagttctgcaactatccttccagcatgagggaccatattgattaccgctgctgcctgcccccagcaacccaccgtcctcatcccaccagcatctgtgacaacttctcggcttatggctggtgccccctgggaccacagtgtcctcagtctcacgatattgaccttatcattgacactgatgaggctgcggcagaggacaagcggcgacggcgacgacgtagggaaaaacggaagagggctttattgaacctaccggggacacagacctctggggaagctaaggatggtcctcccaagaagcaggtctgtggggatagcatcaagcctgaagaaaccgagcaggaggtggctgccgatgaaactaggaacctgcctcactccaagcaaggcaacaaaaatgacttagagatggggattaaggcagcaaggcctgaaatagctgatagagctacctcagaagtgccagggagccaagccagtcctaacccagtgcctggggatggattgcaccgggctggttttgatgcctttatgacaggttatgtgatggcctatgtggaagtgagccagggaccgcagccctgcagctctggaccctggctccctgaatgccacaataaggtatatttgagtggcaaagctgtacccctcacagtggccaagagccagttctctcgttcctccaaagcccacaatcagaagatgaagctcacttggggcagtagctgatgcaacttccaccttgctctcaggtggaacagaggtattttgggtctctctagcctgaaatgtcatcctcaactgctactgagtttaggggagggggaatgtcttgacagacatcactgcattgccctggaccgcctcctttatcccagtgtttgaggtacaagtaagaaggctgaccagcacctgtaacactgactttatttttaagtctgaaaatgtcttgggaaagttttacaaaaaaaaaaatcaacagaagcaagttatgaaaatatt

SEQ ID NO: 31004 - DNA, 1547 bp, Homo sapiens
agcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatggccgccgacagtgacgatggcgcagtttcagctcccgcagcttccgacggagctgagtgggcttggggacaggaagagtttgctgaaccaggtgaacattcctatctggctcaagtgttcaatctcactctgctgtgcatggaggagtatgtcatagaaccaaagtctgtgcagttcctgatacagcatggcttcaacttcaaccagcagtatgcccaaggcatcccctaccataagggcaatgacaagggtgatgagagccagagccagtcagtacggaccctattcctggagctaatccgagcccgccggcccctggtgctacacaatggccttatagacttggtgttcctgtaccagaacttctatgcacacctccctgagagtctgggaaccttcaccgctgacctgtgtgagatgttcccagcaggcatttatgacaccaaatatgctgctgagtttcatgcccgtttcgtggcctcctacttagaatatgccttccggaaatgtgaacgggaaaatgggaagcagcgggcagctggcagcccacaccttaccctggagttctgcaactatccttccagcatgagggaccatattgattaccgctgctgcctgcccccagcaacccaccgtcctcatcccaccagcatctgtgacaacttctcggcttatggctggtgccccctgggaccacagtgtcctcagtctcacgatattgaccttatcattgacactgatgaggctgcggcagaggacaagcggcgacggcgacgacgtagggaaaaacggaagagggctttattgaacctaccggggacacagacctctggggaagctaaggatggtcctcccaagaagcaggtctgtggggatagcatcaagcctgaagaaaccgagcaggaggtggctgccgatgaaactaggaacctgcctcactccaagcaaggcaacaaaaatgacttagagatggggattaaggcagcaaggcctgaaatagctgatagagctacctcagaagtgccagggagccaagccagtcctaacccagtgcctggggatggattgcaccgggctggttttgatgcctttatgacaggttatgtgatggcctatgtggaagtgagccagggaccgcagccctgcagctctggaccctggctccctgaatgccacaataaggtatatttgagtggcaaagctgtacccctcacagtggccaagagccagttctctcgttcctccaaagcccacaatcagaagatgaagctcacttggggcagtagctgatgcaacttccaccttgctctcaggtggaacagaggtattttgggtctctctagcctg

SEQ ID NO: 31005 - DNA, 2352 bp, Homo sapiens
gggcgggtgactacttccggtgcagtgaaggctcggggctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggcaattgaaaagctgcaggccggtgctcttgcaactgacgcagtcactgcagcactggtggaacttgaggattctccttttacaaatgcaggaatgggatctaatctaaatctgttaggtgaaattgagtgtgatgccagcataatggatggaaaatccttaaattttggagcagttggagcactgagtggaatcaagaacccagtctcggttgccaacagactcttatgtgaagggcagaagggcaagctctcggctggcagaattcctccctgctttttagttggagaaggagcctacagatgggcagtagatcatggaataccctcttgccctcctaacatcatgaccacaagattcagtttagctgcatttaaaagaaacaagaggaaactagagctggcagaaagggtggacacagattttatgcaactaaagaaaagaagacaatcaagtgagaaggaaaatgactcaggcactttggacacggtaggcgctgtggttgtggaccacgaagggaatgttgctgctgctgtctccagtggaggcttggccttgaaacatccggggagagttgggcaggctgctctttatggatgtggctgctgggctgaaaatactggagctcataacccctactccacagctgtgagtacctcaggatgtggagagcatcttgtgcgcaccatactggctagagaatgttcacatgctttacaagctgaggatgctcaccaagccctgttggagactatgcaaaacaagtttatcagttcacctttccttgccagtgaagatggcgtgcttggcggagtgattgtcctccgttcatgcagatgttctgccgagcctgactcctcccaaaataagcagacacttctagtggaatttctgtggagccacacgacggagagcatgtgtgtcggatatatgtcagcccaggatgggaaagccaagactcacatttcaagacttcctcctggtgcggtggcaggacagtctgtggcaatcgaaggtggggtgtgccgcctggagagcccagtgaactgacccttcaggctgagtgtgaagcgtctcagaggcatttcagaacctgagcttttgggggtttttaactgaagttggttgttttatctttcttgttttataattcctattgcaacctcgtgcactgctcgagacacaagtgctgctgtagttagcgcttagtgacacgcgggcctttggtgggtgagcgggactgtgtgtgagtgtgtgcgcgtatgtgcgcacatatgtgtatgtgtggagtatgtgtgtttgcttctccgtggatgaaatagaaactcctcattgtgtgaccaggaatggttaaatcatctttacaaaatgtgtgctttaactgtttacaagtaaaacctaaagttgcaggaaacattttttatttcgtaaagaggtaccaactgtcgctgatgtgatatgtcagaactgaagagtaaatctacttgtttaaatgacttgacagtggtagtgctccatttaataacagtaataagtaataaagtgtttttatttgttaaccagtttaagtggatcctgtggtaacttaaactgttgttctcatcccttatatggggcatttttctttaacaaagaatggtttcagtgaaacaatctagcagagaattaatgtcagaacctttttaaataatagtctgattgatacagtttgtacttatttcatcaagcttttctaagcttaaatattgcatagcttcgagctgtatggactatattatgaaagaatatgtaaagagaacatacagtaatgcacagtccttaatttgtgtataatggaaagttatttacaatataacactgtaaataagaaagcaaagtttatgggaaaattcaatattatctttgtttttgtttaaatatatttttaagataaaggcacaaaaataaaagaagcgtattactgggtatagtatgtgactcctcttctcagactaataaattatcttttgaatccttgg

SEQ ID NO: 31006 - DNA, 2281 bp, Homo sapiens
gggtgactacttccggtgcagtgaaggctcggggctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggattctccttttacaaatgcaggaatgggatctaatctaaatctgttaggtgaaattgagtgtgatgccagcataatggatggaaaatccttaaattttggagcagttggagcactgagtggaatcaagaacccagtctcggttgccaacagactcttatgtgaagggcagaagggcaagctctcggctggcagaattcctccctgctttttagttggagaaggagcctacagatgggcagtagatcatggaataccctcttgccctcctaacatcatgaccacaagattcagtttagctgcatttaaaagaaacaagaggaaactagagctggcagaaagggtggacacagattttatgcaactaaagaaaagaagacaatcaagtgagaaggaaaatgactcaggcactttggacacggtaggcgctgtggttgtggaccacgaagggaatgttgctgctgctgtctccagtggaggcttggccttgaaacatccggggagagttgggcaggctgctctttatggatgtggctgctgggctgaaaatactggagctcataacccctactccacagctgtgagtacctcaggatgtggagagcatcttgtgcgcaccatactggctagagaatgttcacatgctttacaagctgaggatgctcaccaagccctgttggagactatgcaaaacaagtttatcagttcacctttccttgccagtgaagatggcgtgcttggcggagtgattgtcctccgttcatgcagatgttctgccgagcctgactcctcccaaaataagcagacacttctagtggaatttctgtggagccacacgacggagagcatgtgtgtcggatatatgtcagcccaggatgggaaagccaagactcacatttcaagacttcctcctggtgcggtggcaggacagtctgtggcaatcgaaggtggggtgtgccgcctggagagcccagtgaactgacccttcaggctgagtgtgaagcgtctcagaggcatttcagaacctgagcttttgggggtttttaactgaagttggttgttttatctttcttgttttataattcctattgcaacctcgtgcactgctcgagacacaagtgctgctgtagttagcgcttagtgacacgcgggcctttggtgggtgagcgggactgtgtgtgagtgtgtgcgcgtatgtgcgcacatatgtgtatgtgtggagtatgtgtgtttgcttctccgtggatgaaatagaaactcctcattgtgtgaccaggaatggttaaatcatctttacaaaatgtgtgctttaactgtttacaagtaaaacctaaagttgcaggaaacattttttatttcgtaaagaggtaccaactgtcgctgatgtgatatgtcagaactgaagagtaaatctacttgtttaaatgacttgacagtggtagtgctccatttaataacagtaataagtaataaagtgtttttatttgttaaccagtttaagtggatcctgtggtaacttaaactgttgttctcatcccttatatggggcatttttctttaacaaagaatggtttcagtgaaacaatctagcagagaattaatgtcagaacctttttaaataatagtctgattgatacagtttgtacttatttcatcaagcttttctaagcttaaatattgcatagcttcgagctgtatggactatattatgaaagaatatgtaaagagaacatacagtaatgcacagtccttaatttgtgtataatggaaagttatttacaatataacactgtaaataagaaagcaaagtttatgggaaaattcaatattatctttgtttttgtttaaatatatttttaagataaaggcacaaaaataaaagaagcgtattactgggtatagtatgtgactcctcttctcagactaataaattatcttttgaatccttggtt

SEQ ID NO: 31007 - DNA, 426 bp, Homo sapiens
gtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggcaattgaaaagctgcaggccggtgctcttgcaactgacgcagtcactgcagcactggtggaacttgagctcatgtggaaaggacaatttcaggtactgtgtgtgctaactaacctcttcctggacatcataaagaatccaactaaaacaaagtttaaaactatttcaaatgtgaaagtttattgaagccaatattctattttagagatttgtgttatgtttttgacaagtaactgtactgtaattatgtggctttcaattaaaaaatgtgaaaactgtt

SEQ ID NO: 31008 - DNA, 1000 bp, Homo sapiens
gctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggattctccttttacaaatgcaggaatgggatctaatctaaatctgttaggtgaaattgagtgtgatgccagcataatggatggaaaatccttaaattttggagcagttggagcactgagtggaatcaagaacccagtctcggttgccaacagactcttatgtgaagggcagaagggcaagctctcggctggcagaattcctccctgctttttagttggagaaggagcctacagatgggcagtagatcatggaataccctcttgccctcctaacatcatgaccacaagattcagtttagctgcatttaaaagaaacaagaggaaactagagctggcagaaagggtggacacagattttatgcaactaaagaaaagaagacaatcaagtgagaaggaaaatgactcaggcactttggacacggtaggcgctgtggttgtggaccacgaagggaatgttgctgctgctgtctccagtggaggcttggccttgaaacatccggggagagttgggcaggctgctctttatggatgtggctgctgggctgaaaatactggagctcataacccctactccacagctgtgagtacctcaggatgtggagagcatcttgtgcgcaccatactggctagagaatgttcacatgctttacaagctgaggatgctcaccaagccctgttggagactatgcaaaacaagtttatca

SEQ ID NO: 31009 - DNA, 952 bp, Homo sapiens
acttccggtgcagtgaaggctcggggctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggcaattgaaaagctgcaggccggtgctcttgcaactgacgcagtcactgcagcactggtggaacttgaggatgtggagagcatcttgtgcgcaccatactggctagagaatgttcacatgctttacaagctgaggatgctcaccaagccctgttggagactatgcaaaacaagtttatcagttcacctttccttgccagtgaagatggcgtgcttggcggagtgattgtcctccgttcatgcagatgttctgccgagcctgactcctcccaaaataagcagacacttctagtggaatttctgtggagccacacgacggagagcatgtgtgtcggatatatgtcagcccaggatgggaaagccaagactcacatttcaagacttcctcctggtgcggtggcaggacagtctgtggcaatcgaagttggccagcgcagaagcttattgaatttatttaccttttcagagtttccctttaagcactacttttgcctcatcctacaaattttggtggctgtggacctggcaaaaactacatttcccagcatccacttcatctgagtgcgaccatatgacacaattctgccccatgaggagtaagtggaaggttctggacagaactgctgcaaag

SEQ ID NO: 31010 - DNA, 900 bp, Homo sapiens
agtgaaggctcggggctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggcaattgaaaagctgcaggccggtgctcttgcaactgacgcagtcactgcagcactggtggaacttgaggtgtacacacacagttacacttcatggagttgcatccagccaagtatccatgtccttcttgtgaagaggcagagaaaatcacctctcccaagaatttccaccttctgaacaagggaaatgtatcctgaagagctgtacgcagatgggaggcaacttgtttgcttgttctgctgctagagcattgatttaattagaagacaggctgtgggtggccatgtgcagacaaagaagcaccagacagagcccatttagcctgggacagtaaaagtaagttacactctttttaaaacacttttttgagtactgatgctgattcttgcctttagtactaaggggcaacttgtaacttactgtttgtgtttacacatagatacatccgttctttttctgagaccctagaaatgacacatgctctctagcacaaagtacctgcttaatggaaaagcagtgatttcttccccaactgcccttttttttttttaaagaataaaaagaaaacggaatcaatgattacattcta

SEQ ID NO: 31011 - DNA, 2426 bp, Homo sapiens
gaagttaggaagcatccggcagctgccttctatttaagcaactggcctccttagaggccactccttggccatgccaggcgcgggcatctggccagcatgctgctctgcacggctcgcctggtcggcctgcagcttctcatttcctgctgctgggcctttgcctgccatagcacggagtcttctcctgacttcaccctccccggagattacctcctggcaggcctgttccctctccattctggctgtctgcaggtgaggcacagacccgaggtgaccctgtgtgacaggtcttgtagcttcaatgagcatggctaccacctcttccaggctatgcggcttggggttgaggagataaacaactccacggccctgctgcccaacatcaccctggggtaccagctgtatgatgtgtgttctgactctgccaatgtgtatgccacgctgagagtgctctccctgccagggcaacaccacatagagctccaaggagaccttctccactattcccctacggtgctggcagtgattgggcctgacagcaccaaccgtgctgccaccacagccgccctgctgagccctttcctggtgcccatgattagctatgcggccagcagcgagacgctcagcgtgaagcggcagtatccctctttcctgcgcaccatccccaatgacaagtaccaggtggagaccatggtgctgctgctgcagaagttcgggtggacctggatctctctggttggcagcagtgacgactatgggcagctaggggtgcaggcactggagaaccaggccactggtcaggggatctgcattgctttcaaggacatcatgcccttctctgcccaggtgggcgatgagaggatgcagtgcctcatgcgccacctggcccaggccggggccaccgtcgtggttgttttttccagccggcagttggccagggtgtttttcgagtccgtggtgctgaccaacctgactggcaaggtgtgggtcgcctcagaagcctgggccctctccaggcacatcactggggtgcccgggatccagcgcattgggatggtgctgggcgtggccatccagaagagggctgtccctggcctgaaggcgtttgaagaagcctatgcccgggcagacaagaaggcccctaggccttgccacaagggctcctggtgcagcagcaatcagctctgcagagaatgccaagctttcatggcacacacgatgcccaagctcaaagccttctccatgagttctgcctacaacgcataccgggctgtgtatgcggtggcccatggcctccaccagctcctgggctgtgcctctggagcttgttccaggggccgagtctacccctggcagacctctacagatgccagccttgtgggaaagaagagtgggcacctgagggaagccagacctgcttcccgcgcactgtggtgtttttggctttgcgtgagcacacctcttgggtgctgctggcagctaacacgctgctgctgctgctgctgcttgggactgctggcctgtttgcctggcacctagacacccctgtggtgaggtcagcagggggccgcctgtgctttcttatgctgggctccctggcagcaggtagtggcagcctctatggcttctttggggaacccacaaggcctgcgtgcttgctacgccaggccctctttgcccttggtttcaccatcttcctgtcctgcctgacagttcgctcattccaactaatcatcatcttcaagttttccaccaaggtacctacattctaccacgcctgggtccaaaaccacggtgctggcctgtttgtgatgatcagctcagcggcccagctgcttatctgtctaacttggctggtggtgtggaccccactgcctgctagggaataccagcgcttcccccatctggtgatgcttgagtgcacagagaccaactccctgggcttcatactggccttcctctacaatggcctcctctccatcagtgcctttgcctgcagctacctgggtaaggacttgccagagaactacaacgaggccaaatgtgtcaccttcagcctgctcttcaacttcgtgtcctggatcgccttcttcaccacggccagcgtctacgacggcaagtacctgcctgcggccaacatgatggctgggctgagcagcctgagcagcggcttcggtgggtattttctgcctaagtgctacgtgatcctctgccgcccagacctcaacagcacagagcacttccaggcctccattcaggactacacgaggcgctgcggctccacctgaccagtgggtcagcaggcacggctggcagccttctctgccctgagggtcgaaggtcgagcaggccgggggtgtccgggaggtctttgggcatcgcggtctggggttgggacgtgtaagcgcctgggagagcctagacca

SEQ ID NO: 31012 - DNA, 2892 bp, Homo sapiens
cctgcccagttcctgagtgggaccgcaggcccggaatgtcaaggcaaacagtcctgcttcagccactgggctccagtcccaccccttttgggggcctgaagttaggaagcatccggcagctgccttctatttaagcaactggcctccttagaggccactccttggccatgccaggcgcgggcatctggccagcatgctgctctgcacggctcgcctggtcggcctgcagcttctcatttcctgctgctgggcctttgcctgccatagcacggagtcttctcctgacttcaccctccccggagattacctcctggcaggcctgttccctctccattctggctgtctgcaggtgaggcacagacccgaggtgaccctgtgtgacaggtcttgtagcttcaatgagcatggctaccacctcttccaggctatgcggcttggggttgaggagataaacaactccacggccctgctgcccaacatcaccctggggtaccagctgtatgatgtgtgttctgactctgccaatgtgtatgccacgctgagagtgctctccctgccagggcaacaccacatagagctccaaggagaccttctccactattcccctacggtgctggcagtgattgggcctgacagcaccaaccgtgctgccaccacagccgccctgctgagccctttcctggtgcccatgattagctatgcggccagcagcgagacgctcagcgtgaagcggcagtatccctctttcctgcgcaccatccccaatgacaagtaccaggtggagaccatggtgctgctgctgcagaagttcgggtggacctggatctctctggttggcagcagtgacgactatgggcagctaggggtgcaggcactggagaaccaggccactggtcaggggatctgcattgctttcaaggacatcatgcccttctctgcccaggtgggcgatgagaggatgcagtgcctcatgcgccacctggcccaggccggggccaccgtcgtggttgttttttccagccggcagttggccagggtgtttttcgagtccgtggtgctgaccaacctgactggcaaggtgtgggtcgcctcagaagcctgggccctctccaggcacatcactggggtgcccgggatccagcgcattgggatggtgctgggcgtggccatccagaagagggctgtccctggcctgaaggcgtttgaagaagcctatgcccgggcagacaagaaggcccctaggccttgccacaagggctcctggtgcagcagcaatcagctctgcagagaatgccaagctttcatggcacacacgatgcccaagctcaaagccttctccatgagttctgcctacaacgcataccgggctgtgtatgcggtggcccatggcctccaccagctcctgggctgtgcctctggagcttgttccaggggccgagtctacccctggcagcttttggagcagatccacaaggtgcatttccttctacacaaggacactgtggcgtttaatgacaacagagatcccctcagtagctataacataattgcctgggactggaatggacccaagtggaccttcacggtcctcggttcctccacatggtctccagttcagctaaacataaatgagaccaaaatccagtggcacggaaaggacaaccaggtgcctaagtctgtgtgttccagcgactgtcttgaagggcaccagcgagtggttacgggtttccatcactgctgctttgagtgtgtgccctgtggggctgggaccttcctcaacaagagtgacctctacagatgccagccttgtgggaaagaagagtgggcacctgagggaagccagacctgcttcccgcgcactgtggtgtttttggctttgcgtgagcacacctcttgggtgctgctggcagctaacacgctgctgctgctgctgctgcttgggactgctggcctgtttgcctggcacctagacacccctgtggtgaggtcagcagggggccgcctgtgctttcttatgctgggctccctggcagcaggtagtggcagcctctatggcttctttggggaacccacaaggcctgcgtgcttgctacgccaggccctctttgcccttggtttcaccatcttcctgtcctgcctgacagttcgctcattccaactaatcatcatcttcaagttttccaccaaggtacctacattctaccacgcctgggtccaaaaccacggtgctggcctgtttgtgatgatcagctcagcggcccagctgcttatctgtctaacttggctggtggtgtggaccccactgcctgctagggaataccagcgcttcccccatctggtgatgcttgagtgcacagagaccaactccctgggcttcatactggccttcctctacaatggcctcctctccatcagtgcctttgcctgcagctacctgggtaaggacttgccagagaactacaacgaggccaaatgtgtcaccttcagcctgctcttcaacttcgtgtcctggatcgccttcttcaccacggccagcgtctacgacggcaagtacctgcctgcggccaacatgatggctgggctgagcagcctgagcagcggcttcggtgggtattttctgcctaagtgctacgtgatcctctgccgcccagacctcaacagcacagagcacttccaggcctccattcaggactacacgaggcgctgcggctccacctgaccagtgggtcagcaggcacggctggcagccttctctgccctgagggtcgaaggtcgagcaggccgggggtgtccgggaggtctttgggcatcgcggtctggggttgggacgtgtaagcgcctgggagagcctagaccaggctccgggctgccaataaagaagtgaaatgcgta

SEQ ID NO: 31013 - DNA, 1871 bp, Homo sapiens
atttaagcaactggcctccttagaggccactccttggccatgccaggcgcgggcatctggccagcatgctgctctgcacggctcgcctggtcggcctgcagcttctcatttcctgctgctgggcctttgcctgccatagcacggagtcttctcctgacttcaccctccccggagattacctcctggcaggcctgttccctctccattctggctgtctgcaggtgaggcacagacccgaggtgaccctgtgtgacaggtcttgtagcttcaatgagcatggctaccacctcttccaggctatgcggcttggggttgaggagataaacaactccacggccctgctgcccaacatcaccctggggtaccagctgtatgatgtgtgttctgactctgccaatgtgtatgccacgctgagagtgctctccctgccagggcaacaccacatagagctccaaggagaccttctccactattcccctacggtgctggcagtgattgggcctgacagcaccaaccgtgctgccaccacagccgccctgctgagccctttcctggtgcccatgcttttggagcagatccacaaggtgcatttccttctacacaaggacactgtggcgtttaatgacaacagagatcccctcagtagctataacataattgcctgggactggaatggacccaagtggaccttcacggtcctcggttcctccacatggtctccagttcagctaaacataaatgagaccaaaatccagtggcacggaaaggacaaccaggtgcctaagtctgtgtgttccagcgactgtcttgaagggcaccagcgagtggttacgggtttccatcactgctgctttgagtgtgtgccctgtggggctgggaccttcctcaacaagagtgacctctacagatgccagccttgtgggaaagaagagtgggcacctgagggaagccagacctgcttcccgcgcactgtggtgtttttggctttgcgtgagcacacctcttgggtgctgctggcagctaacacgctgctgctgctgctgctgcttgggactgctggcctgtttgcctggcacctagacacccctgtggtgaggtcagcagggggccgcctgtgctttcttatgctgggctccctggcagcaggtagtggcagcctctatggcttctttggggaacccacaaggcctgcgtgcttgctacgccaggccctctttgcccttggtttcaccatcttcctgtcctgcctgacagttcgctcattccaactaatcatcatcttcaagttttccaccaaggtacctacattctaccacgcctgggtccaaaaccacggtgctggcctgtttgtgatgatcagctcagcggcccagctgcttatctgtctaacttggctggtggtgtggaccccactgcctgctagggaataccagcgcttcccccatctggtgatgcttgagtgcacagagaccaactccctgggcttcatactggccttcctctacaatggcctcctctccatcagtgcctttgcctgcagctacctgggtaaggacttgccagagaactacaacgaggccaaatgtgtcaccttcagcctgctcttcaacttcgtgtcctggatcgccttcttcaccacggccagcgtctacgacggcaagtacctgcctgcggccaacatgatggctgggctgagcagcctgagcagcggcttcggtgggtattttctgcctaagtgctacgtgatcctctgccgcccagacctcaacagcacagagcacttccaggcctccattcaggactacacgaggcgctgcggctccacctgaccagtgggtcagcaggcacggctggcagccttctctgccctg

SEQ ID NO: 31014 - DNA, 1251 bp, Homo sapiens
gaagttaggaagcatccggcagctgccttctatttaagcaactggcctccttagaggccactccttggccatgccaggcgcgggcatctggccagcatgctgctctgcacggctcgcctggtcggcctgcagcttctcatttcctgctgctgggcctttgcctgccatagcacggagtcttctcctgacttcaccctccccggagattacctcctggcaggcctgttccctctccattctggctgtctgcaggtgaggcacagacccgaggtgaccctgtgtgacaggtcttgtagcttcaatgagcatggctaccacctcttccaggctatgcggcttggggttgaggagataaacaactccacggccctgctgcccaacatcaccctggggtaccagctgtatgatgtgtgttctgactctgccaatgtgtatgccacgctgagagtgctctccctgccagggcaacaccacatagagctccaaggagaccttctccactattcccctacggtgctggcagtgattgggcctgacagcaccaaccgtgctgccaccacagccgccctgctgagccctttcctggtgcccatgcttttggagcagatccacaaggtgcatttccttctacacaaggacactgtggcgtttaatgacaacagagatcccctcagtagctataacataattgcctgggactggaatggacccaagtggaccttcacggtcctcggttcctccacatggtctccagttcagctaaacataaatgagaccaaaatccagtggcacggaaaggacaaccaggtgcctaagtctgtgtgttccagcgactgtcttgaagggcaccagcgagtggttacgggtttccatcactgctgctttgagtgtgtgccctgtggggctgggaccttcctcaacaagagtgacctctacagatgccagccttgtgggaaagaagagtgggcacctgagggaagccagacctgcttcccgcgcactgtggtgtttttggctttgcgtgagcacacctcttgggtgctgctggcagctaacacgctgctgctgctgctgctgcttgggactgctggcctgtttgcctggcacctagacacccctgtggtgaggtcagcagggggccgcctgtgctttcttatgctgggctccctggcagcaggtagtggcagcctctatggcttctttggggagccctctttgcccttggtttcaccatcttcctgtcctgcctga

SEQ ID NO: 31015 - DNA, 2542 bp, Homo sapiens
ctgagaccatcacttcccagccatggggcccagggcaaagaccatctcctccctgttcttcctcctatgggtcctggctgagccggctgagaactcggacttctacctgcctggggattacctcctgggtggcctcttctccctccatgccaacatgaagggcattgttcaccttaacttcctgcaggtgcccatgtgcaaggagtatgaagtgaaggtgataggctacaacctcatgcaggccatgcgctttgcggtggaggagatcaacaatgacagcagcctgctgcctggtgtgctgctgggctatgagatcgtggatgtgtgctacatctccaacaatgtccagccggtgctctacttcctggcacacgaggacaacctccttcccatccaagaggactacagtaactacatttcccgtgtggtggctgtcattggccctgacaactccgagtctgtcatgactgtggccaacttcctctccctatttctccttccacagatcacctacagcgccatcagcgatgagctgcgagacaaggtgcgcttcccggctttgctgcgtaccacacccagcgccgaccaccacatcgaggccatggtgcagctgatgctgcacttccgctggaactggatcattgtgctggtgagcagcgacacctatggccgcgacaatggccagctgcttggcgagcgcgtggcccggcgcgacatctgcatcgccttccaggagacgctgcccacactgcagcccaaccagaacatgacgtcagaggagcgccagcgcctggtgaccattgtggacaagctgcagcagagcacagcgcgcgtcgtggtcgtgttctcgcccgacctgaccctgtaccacttcttcaatgaggtgctgcgccagaacttcactggcgccgtgtggatcgcctccgagtcctgggccatcgacccggtcctgcacaacctcacggagctgcgccacttgggcaccttcctgggcatcaccatccagagcgtgcccatcccgggcttcagtgagttccgcgagtggggcccacaggctgggccgccacccctcagcaggaccagccagagctatacctgcaaccaggagtgcgacaactgcctgaacgccaccttgtccttcaacaccattctcaggctctctggggagcgtgtcgtctacagcgtgtactctgcggtctatgctgtggcccatgccctgcacagcctcctcggctgtgacaaaagcacctgcaccaagagggtggtctacccctggcagctgcttgaggagatctggaaggtcaacttcactctcctggaccaccaaatcttcttcgacccgcaaggggacgtggctctgcacttggagattgtccagtggcaatgggaccggagccagaatcccttccagagcgtcgcctcctactaccccctgcagcgacagctgaagaacatccaagacatctcctggcacaccatcaacaacacgatccctatgtccatgtgttccaagaggtgccagtcagggcaaaagaagaagcctgtgggcatccacgtctgctgcttcgagtgcatcgactgccttcccggcaccttcctcaaccacactgaagatgaatatgaatgccaggcctgcccgaataacgagtggtcctaccagagtgagacctcctgcttcaagcggcagctggtcttcctggaatggcatgaggcacccaccatcgctgtggccctgctggccgccctgggcttcctcagcaccctggccatcctggtgatattctggaggcacttccagacacccatagttcgctcggctgggggccccatgtgcttcctgatgctgacactgctgctggtggcatacatggtggtcccggtgtacgtggggccgcccaaggtctccacctgcctctgccgccaggccctctttcccctctgcttcacaatctgcatctcctgtatcgccgtgcgttctttccagatcgtctgcgccttcaagatggccagccgcttcccacgcgcctacagctactgggtccgctaccaggggccctacgtctctatggcatttatcacggtactcaaaatggtcattgtggtaattggcatgctggccacgggcctcagtcccaccacccgtactgaccccgatgaccccaagatcacaattgtctcctgtaaccccaactaccgcaacagcctgctgttcaacaccagcctggacctgctgctctcagtggtgggtttcagcttcgcctacatgggcaaagagctgcccaccaactacaacgaggccaagttcatcaccctcagcatgaccttctatttcacctcatccgtctccctctgcaccttcatgtctgcctacagcggggtgctggtcaccatcgtggacctcttggtcactgtgctcaacctcctggccatcagcctgggctacttcggccccaagtgctacatgatcctcttctacccggagcgcaacacgcccgcctacttcaacagcatgatccagggctacaccatgaggagggactag

SEQ ID NO: 31016 - DNA, 3433 bp, Homo sapiens
acctgccgtgcctgttggaagttgcctctgccatgctgggccctgctgtcctgggcctcagcctctgggctctcctgcaccctgggacgggggccccattgtgcctgtcacagcaacttaggatgaagggggactacgtgctgggggggctgttccccctgggcgaggccgaggaggctggcctccgcagccggacacggcccagcagccctgtgtgcaccaggttctcctcaaacggcctgctctgggcactggccatgaaaatggccgtggaggagatcaacaacaagtcggatctgctgcccgggctgcgcctgggctacgacctctttgatacgtgctcggagcctgtggtggccatgaagcccagcctcatgttcctggccaaggcaggcagccgcgacatcgccgcctactgcaactacacgcagtaccagccccgtgtgctggctgtcatcgggccccactcgtcagagctcgccatggtcaccggcaagttcttcagcttcttcctcatgccccaggtcagctacggtgctagcatggagctgctgagcgcccgggagaccttcccctccttcttccgcaccgtgcccagcgaccgtgtgcagctgacggccgccgcggagctgctgcaggagttcggctggaactgggtggccgccctgggcagcgacgacgagtacggccggcagggcctgagcatcttctcggccctggccgcggcacgcggcatctgcatcgcgcacgagggcctggtgccgctgccccgtgccgatgactcgcggctggggaaggtgcaggacgtcctgcaccaggtgaaccagagcagcgtgcaggtggtgctgctgttcgcctccgtgcacgccgcccacgccctcttcaactacagcatcagcagcaggctctcgcccaaggtgtgggtggccagcgaggcctggctgacctctgacctggtcatggggctgcccggcatggcccagatgggcacggtgcttggcttcctccagaggggtgcccagctgcacgagttcccccagtacgtgaagacgcacctggccctggccaccgacccggccttctgctctgccctgggcgagagggagcagggtctggaggaggacgtggtgggccagcgctgcccgcagtgtgactgcatcacgctgcagaacgtgagcgcagggctaaatcaccaccagacgttctctgtctacgcagctgtgtatagcgtggcccaggccctgcacaacactcttcagtgcaacgcctcaggctgccccgcgcaggaccccgtgaagccctggcagctcctggagaacatgtacaacctgaccttccacgtgggcgggctgccgctgcggttcgacagcagcggaaacgtggacatggagtacgacctgaagctgtgggtgtggcagggctcagtgcccaggctccacgacgtgggcaggttcaacggcagcctcaggacagagcgcctgaagatccgctggcacacgtctgacaaccagaagcccgtgtcccggtgctcgcggcagtgccaggagggccaggtgcgccgggtcaaggggttccactcctgctgctacgactgtgtggactgcgaggcgggcagctaccggcaaaacccagacgacatcgcctgcaccttttgtggccaggatgagtggtccccggagcgaagcacacgctgcttccgccgcaggtctcggttcctggcatggggcgagccggctgtgctgctgctgctcctgctgctgagcctggcgctgggccttgtgctggctgctttggggctgttcgttcaccatcgggacagcccactggttcaggcctcgggggggcccctggcctgctttggcctggtgtgcctgggcctggtctgcctcagcgtcctcctgttccctggccagcccagccctgcccgatgcctggcccagcagcccttgtcccacctcccgctcacgggctgcctgagcacactcttcctgcaggcggccgagatcttcgtggagtcagaactgcctctgagctgggcagaccggctgagtggctgcctgcgggggccctgggcctggctggtggtgctgctggccatgctggtggaggtcgcactgtgcacctggtacctggtggccttcccgccggaggtggtgacggactggcacatgctgcccacggaggcgctggtgcactgccgcacacgctcctgggtcagcttcggcctagcgcacgccaccaatgccacgctggcctttctctgcttcctgggcactttcctggtgcggagccagccgggctgctacaaccgtgcccgtggcctcacctttgccatgctggcctacttcatcacctgggtctcctttgtgcccctcctggccaatgtgcaggtggtcctcaggcccgccgtgcagatgggcgccctcctgctctgtgtcctgggcatcctggctgccttccacctgcccaggtgttacctgctcatgcggcagccagggctcaacacccccgagttcttcctgggagggggccctggggatgcccaaggccagaatgacgggaacacaggaaatcaggggaaacatgagtgacccaaccctgtgatctcagccccggtgaacccagacttagctgcgatcccccccaagccagcaatgacccgtgtctcgctacagagaccctcccgctctaggttctgaccccaggttgtctcctgaccctgaccccacagtgagccctaggcctggagcacgtggacacccctgtgaccatctgggccccagagccaagctgtgtccctgtccctctgtgcccagaccaggcctgcccaggtaacccagacccactgttctggaaagaggcccggagggctcccagggtacccgcaacccacaccgtgagctcaggaaaaggacgcagggaggccccggccagatggctggaagcccaaatcaggccctgccgacctgaccatgtcccaccagggcccccatcctgcaccctgccaggcaccacagcagtgggaggccaggtgggggcacacaggcatatgcccagggcagagcccgccgaggtaggggtggcacccagcttcctactctgccctttgcccagtgggtagacagcatcatgactgtcaccagtaccagggacagagcccaggtggggtgggggcggggtccagcaccacggccagcaccgaccaccaggaccccggagccagcaccatggacagaaaactgcccaccaggatctgacgccagcacgccgccaggcccacacagggtctccggtcagagtcccagggtcagctcccagcagggcctaggggaggctggaccagctccctgtgcctcattccaaggcagcccagccggagagaaggggcacaggccacacatctgtcccataaaattaaacgctttttagtgtt

SEQ ID NO: 31017 - DNA, 996 bp, Homo sapiens
tctctacctggaaattggtacagagattcagagtctttgtccaggaagacactttggagtagaagaatgatacccatccaactcactgtcttcttcatgatcatctatgtgcttgagtccttgacaattattgtgcagagcagcctaattgttgcagtgctgggcagagaatggctgcaagtcagaaggctgatgcctgtggacatgattctcatcagcctgggcatctctcgcttctgtctacagtgggcatcaatgctgaacaatttttgctcctattttaatttgaattatgtactttgcaacttaacaatcacctgggaattttttaatatccttacattctggttaaacagcttgcttaccgtgttctactgcatcaaggtctcttctttcacccatcacatctttctctggctgaggtggagaattttgaggttgtttccctggatattactgggttctctgatgattacttgtgtaacaatcatcccttcagctattgggaattacattcaaattcagttactcaccatggagcatctaccaagaaacagcactgtaactgacaaacttgaaaattttcatcagtatcagttccaggctcatacagttgcattggttattcctttcatcctgttcctggcctccaccatctttctcatggcatcactgaccaagcagatacaacatcatagcactggtcactgcaatccaagcatgaaagcgcgcttcactgccctgaggtcccttgccgtcttatttattgtgtttacctcttactttctaaccatactcatcaccattataggtactctatttgataagagatgttggttatgggtctgggaagcttttgtctatgctttcatcttaatgcattccacttcactgatgctgagcagccctacgttgaaaaggattctaaagggaaagtgctaggcctagaggttgcctgaggcacaggataaaagactcccgagcaattgatataat

SEQ ID NO: 31018 - DNA, 1002 bp, Homo sapiens
ggactcagaacaagtgttactaagcctgcatttttttatctgttcaaacatgatgtgttttctgctcatcatttcatcaattctggtagtgtttgcatttgttcttggaaatgttgccaatggcttcatagccctagtaaatgtcattgactgggttaacacacgaaagatctcctcagctgagcaaattctcactgctctggtggtctccagaattggtttactctgggtcatgttattcctttggtatgcaactgtgtttaattctgctttatatggtttagaagtaagaattgttgcttctaatgcctgggctgtaacgaaccatttcagcatgtggcttgctgctagcctcagcatattttgtttgctcaagattgccaatttctccaaccttatttctctccacctaaagaagagaattaagagtgttgttctggtgatactgttggggcccttggtatttctgatttgtaatcttgctgtgataaccatggatgagagagtgtggacaaaagaatatgaaggaaatgtgacttggaagatcaaattgaggaatgcaatacacctttcaagcttgactgtaactactctagcaaacctcataccctttactctgagcctaatatgttttctgctgttaatctgttctctttgtaaacatctcaagaagatgcggctccatagcaaaggatctcaagatcccagcaccaaggtccatataaaagctttgcaaactgtgacctccttcctcatgttatttgccatttactttctgtgtataatcacatcaacttggaatcttaggacacagcagagcaaacttgtactcctgctttgccaaactgttgcaatcatgtatccttcattccactcattcatcctgattatgggaagtaggaagctaaaacagacctttctttcagttttgtggcagatgacacgctgagtgaaagaagagaaaccctcaactccatagattcacaaggggagcatcgtggg

SEQ ID NO: 31019 - DNA, 1381 bp, Homo sapiens
atgatgagttttctacacattgttttttccattctagtagtggttgcatttattcttggaaattttgccaatggctttatagcactgataaatttcattgcctgggtcaagagacaaaagatctcctcagctgatcaaattattgctgctctggcagtctccagagttggtttgctctgggtaatattattacattggtattcaactgtgttgaatccaacttcatctaatttaaaagtaataatttttatttctaatgcctgggcagtaaccaatcatttcagcatctggcttgctactagcctcagcatattttatttgctcaagatcgtcaatttctccagacttatttttcatcacttaaaaaggaaggctaagagtgtagttctggtgatagtgttggggtctttgttctttttggtttgtcaccttgtgatgaaacacacgtatataaatgtgtggacagaagaatgtgaaggaaacgtaacttggaagatcaaactgaggaatgcaatgcacctttccaacttgactgtagccatgctagcaaacttgataccattcactctgaccctgatatcttttctgctgttaatctactctctgtgtaaacatctgaagaagatgcagctccatggcaaaggatctcaagatcccagcaccaagatccacataaaagctctgcaaactgtgacctccttcctcatattacttgccatttactttctgtgtctaatcatatcgttttggaattttaagatgcgaccaaaagaaattgtcttaatgctttgccaagcttttggaatcatatatccatcattccactcattcattctgatttgggggaacaagacgctaaagcagacctttctttcagttttgtggcaggtgacttgctgggcaaaaggacagaaccagtcaactccatagattcacaagaggtgcattgtgtgttttctagcagaaaacaaattgatggtgtctggaacattttatatttcccacaagtttttccgtagtctatgtatttgagtaatttccaaaagttgacatagaaaagtcttttacctaagtttattatataaaagtatatatatataatatacatttgcgtgtgtgtgtatgtctgaatgtatatgaaaatttaatatttaccataacatacctttaatcaacttttcatataaactgttcagttataccaaagtaggataagaaatttctcagaattatgaacccatgtgtatttcacacatttttttatatgatatttcatttgaggaatttatgatctctatttataattaagaactgacagcttatatcagaaaatcattgctgtttttcgttgtaaaatcattgctgtttttcgttgtaattt

SEQ ID NO: 31020 - DNA, 1101 bp, Homo sapiens
tcagtgaggagattctatgtatcaacagaaagaacaaagatcagggctgcctaattgctgacatgatgggactcaccgagggggtgttcctgattctgtctggcactcagttcacactgggaattctggtcaattgtttcattgagttggtcaatggtagcagctggttcaagaccaagagaatgtctttgtctgacttcatcatcaccaccctggcactcttgaggatcattctgctgtgtattatcttgactgatagttttttaatagaattctctcccaacacacatgattcagggataataatgcaaattattgatgtttcctggacatttacaaaccatctgagcatttggcttgccacctgtcttggtgtcctctactgcctgaaaatcgccagtttctctcaccccacattcctctggctcaagtggagagtttctagggtgatggtatggatgctgttgggtgcactgctcttatcctgtggtagtaccgcatctctgatcaatgagtttaagctctattctgtctttaggggaattgaggccaccaggaatgtgactgaacacttcagaaagaagaggagtgagtattatctgatccatgttcttgggactctgtggtacctgcctcccttaattgtgtccctggcctcctactctttgctcatcttctccctggggaggcacacacggcagatgctgcaaaatgggacaagctccagagatccaaccactgaggcccacaagagggccatcagaatcatcctttccttcttctttctcttcttactttactttcttgctttcttaattgcatcatttggtaatttcctaccaaaaaccaagatggctaagatgattggcgaagtaatgacaatgttttatcctgctggccactcatttattctcattctggggaacagtaagctgaagcagacatttgtagtgatgctccggtgtgagtctggtcatctgaagcctggatccaagggacccattttctcttagagtaacagagggcatggggtggagcccttgagccttttggcctggctcaagactacaggactcttcctgaccttcctatgttaccagt

SEQ ID NO: 31021 - DNA, 1687 bp, Homo sapiens
gtcgctaaagacaaatgatggagaggttacacaaggaaaaattgcaaacactggaagtgaacatgtccttgtttgcatactagcaaatgagaattcaggtttcatgtcaatttcagtatgaataattccagcctataacaagaacagatggtgaatgagtcagttaatttgaattgttttgaaaataagaatgttttccataaagagagcattgaacttatccattagcatgccatggtgatttctgacttgacactggtcacagcaattaaaagtaaaaagaatgtcacagcacatacacaaatcaggtgcatatagaatttaaggtcaggatattcaagcaatcacaaccagtgatattacaccagcattttaaaaatttctttttgtctgttcagacatgataacttttctgcccatcattttttccattctaatagtggttatatttgttattggaaattttgctaatggcttcatagcattggtaaattccattgagtgggtcaagagacaaaagatctcctttgttgaccaaattctcactgctctggcggtctccagagttggtttgctctgggtgttattactacattggtatgcaactcagttgaatccagctttttatagtgtagaagtaagaattactgcttataatgtctgggcagtaaccaaccatttcagcagctggcttgctactagcctcagcatgttttatttgctcaggattgccaatttctccaaccttatttttcttcgcataaagaggagagttaagagtgttgttctggtgatactgttggggcctttgctatttttggtttgtcatctttttgtgataaacatggatgagactgtatggacaaaagaatatgaaggaaacgtgacttggaagatcaaattgaggagtgcaatgtaccattcaaatatgactctaaccatgctagcaaactttgtacccctcactctgaccctgatatcttttctgctgttaatctgttctctgtgtaaacatctcaagaagatgcagctccatggcaaaggatctcaagatcccagcaccaaggtccacataaaagctttgcaaactgtgacctcctttcttctgttatgtgccatttactttctgtccatgatcatatcagtttgtaattttgggaggctggaaaagcaacctgtcttcatgttctgccaagctattatattcagctatccttcaacccacccattcatcctgattttgggaaacaagaagctaaagcagatttttctttcagttttgcggcatgtgaggtactgggtgaaagacagaagccttcgtctccatagattcacaagaggggcattgtgtgtcttctagcagaaaacaaactggtggtgtatgaaacattttatatttcttactgggttttctgtaatatatgtatatgaataatttccacatgtatacctagaaaagtcttttacctaaagttagtctagaaaagtacatatatatagatgtgtgtgtgtgtgtgtgtgtgtatgaaaaactgaagaacattgacaataacatgctttttattgttttttcacaaaaactgccaaattatagaaaatatgacaaaaattcctcaattatgaagccatgtttatttcatacatgtattttatatttcatttgtagaatttatatctatttataatt

SEQ ID NO: 31022 - DNA, 1021 bp, Homo sapiens
cgaacccacctgcaggaaccaactccggacacaacaccagcattaaaacaatttttttttgtctgttcagacatgacaacttttatacccatcattttttccagtgtggtagtggttctatttgttattggaaattttgctaatggcttcatagcattggtaaattccattgagcgggtcaagagacaaaagatctcttttgctgaccagattctcactgctctggcggtctccagagttggtttgctctgggtattattattaaattggtattcaactgtgtttaatccagctttttatagtgtagaagtaagaactactgcttataatgtctgggcagtaaccggccatttcagcaactggcttgctactagcctcagcatattttatttgctcaagattgccaatttctccaaccttatttttcttcacttaaagaggagagttaagagtgtcattctggtgatgctgttggggcctttactatttttggcttgtcaactttttgtgataaacatgaaagagattgtacggacaaaagaatatgaaggaaacttgacttggaagatcaaattgaggagtgcagtgtacctttcagatgcgactgtaaccacgctaggaaacttagtgcccttcactctgaccctgctatgttttttgctgttaatctgttctctgtgtaaacatctcaagaagatgcagctccatggtaaaggatctcaagatcccagcaccaaggtccacataaaagctttgcaaactgtgatctttttcctcttgttatgtgccgtttactttctgtccataatgatatcagtttggagttttgggagtctggaaaacaaacctgtcttcatgttctgcaaagctattagattcagctatccttcaatccacccattcatcctgatttggggaaacaagaagctaaagcagacttttctttcagttttgcggcaagtgaggtactgggtgaaaggagagaagccttcatctccatagattcatgagaggggcattg

SEQ ID NO: 31023 - DNA, 1143 bp, Homo sapiens
cctttctgcactgggtggcaaccaggtctttagattagccaactagagaagagaagtagaatagccaattagagaagtgacatcatgttgactctaactcgcatccgcactgtgtcctatgaagtcaggagtacatttctgttcatttcagtcctggagtttgcagtggggtttctgaccaatgccttcgttttcttggtgaatttttgggatgtagtgaagaggcaggcactgagcaacagtgattgtgtgctgctgtgtctcagcatcagccggcttttcctgcatggactgctgttcctgagtgctatccagcttacccacttccagaagttgagtgaaccactgaaccacagctaccaagccatcatcatgctatggatgattgcaaaccaagccaacctctggcttgctgcctgcctcagcctgctttactgctccaagctcatccgtttctctcacaccttcctgatctgcttggcaagctgggtctccaggaagatctcccagatgctcctgggtattattctttgctcctgcatctgcactgtcctctgtgtttggtgcttttttagcagacctcacttcacagtcacaactgtgctattcatgaataacaatacaaggctcaactggcagattaaagatctcaatttattttattcctttctcttctgctatctgtggtctgtgcctcctttcctattgtttctggtttcttctgggatgctgactgtctccctgggaaggcacatgaggacaatgaaggtctataccagaaactctcgtgaccccagcctggaggcccacattaaagccctcaagtctcttgtctcctttttctgcttctttgtgatatcatcctgtgctgccttcatctctgtgcccctactgattctgtggcgcgacaaaataggggtgatggtttgtgttgggataatggcagcttgtccctctgggcatgcagccatcctgatctcaggcaatgccaagttgaggagagctgtgatgaccattctgctctgggctcagagcagcctgaaggtaagagccgaccacaaggcagattcccggacactgtgctgagaatggacatgaaatgagctcttcattaatacgcctgtgagtcttcataaatatgcc

SEQ ID NO: 31024 - DNA, 994 bp, Homo sapiens
tgcctccactatcagcaccacaactgctgaatcctcaatgagtaaagatgcttcggttattctatttctctgctattattgcctcagttattttaaattttgtaggaatcattatgaatctgtttattacagtggtcaattgcaaaacttgggtcaaaagccatagaatctcctcttctgataggattctgttcagcctgggcatcaccaggtttcttatgctgggactatttctggtgaacaccatctacttcgtctcttcaaatacggaaaggtcagtctacctgtctgctttttttgtgttgtgtttcatgtttttggactcgagcagtgtctggtttgtgaccttgctcaatatcttgtactgtgtgaagattactaacttccaacactcagtgtttctcctgctgaagcggaatatctccccaaagatccccaggctgctgctggcctgtgtgctgatttctgctttcaccacttgcctgtacatcacgcttagccaggcatcaccttttcctgaacttgtgactacgagaaataacacatcatttaatatcagtgagggcatcttgtctttagtggtttctttggtcttgagctcatctctccagttcatcattaatgtgacttctgcttccttgctaatacactccttgaggagacatatacagaagatgcagaaaaatgccactggtttctggaatccccagacggaagctcatgtaggtgctatgaagctgatggtctatttcctcatcctctacattccatattcagttgctaccctggtccagtatctccccttttatgcagggatggatatggggaccaaatccatttgtctgatttttgccaccctttactctccaggacattctgttctcattattatcacacatcctaaactgaaaacaacagcaaagaagattctttgtttcaaaaaatagtggaatttcagtaaacaatacctagatttacctgatggtttgggggc

SEQ ID NO: 31025 - DNA, 1033 bp, Homo sapiens
cccattcttggcgcagaaacctgaaagtcaggatcaaagagaatggcaacggtgaacacagatgccacagataaagacatatccaagttcaaggtcaccttcactttggtggtctccggaatagagtgcatcactggcatccttgggagtggcttcatcacggccatctatggggctgagtgggccaggggcaaaacactccccactggtgaccgcattatgttgatgctgagcttttccaggctcttgctacagatttggatgatgctggagaacattttcagtctgctattccgaattgtttataaccaaaactcagtgtatatcctcttcaaagtcatcactgtctttctgaaccattccaatctctggtttgctgcctggctcaaagtcttctattgtcttagaattgcaaacttcaatcatcctttgttcttcctgatgaagaggaaaatcatagtgctgatgccttggcttctcaggctgtcagtgttggtttccttaagcttcagctttcctctctcgagagatgtcttcaatgtgtatgtgaatagctccattcctatcccctcctccaactccacggagaagaagtacttctctgagaccaatatggtcaacctggtatttttctataacatggggatcttcgttcctctgatcatgttcatcctggcagccaccctgctgatcctctctctcaagagacacaccctacacatgggaagcaatgccacagggtccagggaccccagcatgaaggctcacataggggccatcaaagccaccagctactttctcatcctctacattttcaatgcaattgctctatttctttccacgtccaacatctttgacacttacagttcctggaatattttgtgcaagatcatcatggctgcctaccctgccggccactcagtacaactgatcttgggcaaccctgggctgagaagagcctggaagcggtttcagcaccaagttcctctttacctaaaagggcagactctgtgactggaactcacggagttct

SEQ ID NO: 31026 - DNA, 924 bp, Homo sapiens
atgcaagcagcactgacggccttcttcgtgttgctctttagcctgctgagtcttctggggattgcagcgaatggcttcattgtgctggtgctgggcagggagtggctgcgatatggcaggttgctgcccttggatatgatcctcattagcttgggtgcctcccgcttctgcctgcagttggttgggacggtgcacaacttctactactctgcccagaaggtcgagtactctgggggtctcggccgacagttcttccatctacactggcacttcctgaactcagccaccttctggttttgcagctggctcagtgtcctgttctgtgtgaagattgctaacatcacacactccaccttcctgtggctgaagtggaggttcccagggtgggtgccctggctcctgttgggctctgtcctgatctccttcatcataaccctgctgtttttttgggtgaactaccctgtatatcaagaatttttaattagaaaattttctgggaacatgacctacaagtggaatacaaggatagaaacatactatttcccatccctgaaactggtcatctggtcaattcctttttctgtttttctggtctcaattatgctgttaattaattctctgaggaggcatactcagagaatgcagcacaacgggcacagcctgcaggaccccagcacccaggctcacaccagagctctgaagtccctcatctccttcctcattctttatgctctgtcctttctgtccctgatcattgatgccgcaaaatttatctccatgcagaacgacttttactggccatggcaaattgcagtctacctgtgcatatctgtccatcccttcatcctcatcttcagcaacctcaagcttcgaagcgtgttctcgcagctcctgttgttggcaaggggcttctgggtggcctag

SEQ ID NO: 31027 - DNA, 945 bp, Homo sapiens
atggccaccgaattggacaaaatctttctgattctggcaatagcagaattcatcatcagcatgctggggaatgtgttcattggactggtaaactgctctgaagggatcaagaaccaaaaggtcttctcagctgacttcatcctcacctgcttggctatctccacaattggacaactgttggtgatactgtttgattcatttctagtgggacttgcttcacatttatataccacatatagactaggaaaaactgttattatgctttggcacatgactaatcacttgacaacctggcttgccacctgcctaagcattttctatttctttaagatagcccacttcccccactcccttttcctctggctgaggtggaggatgaacggaatgattgttatgcttcttatattgtctttgttcttactgatttttgacagtttagtgctagaaatatttattgatatctcactcaatataatagataaaagtaatctgactttatatttagatgaaagtaaaactctctatgataaactctctattttaaaaactcttctcagcttaaccagttttatccccttttctctgttcctgacctccttgctttttttatttctgtccttggtgagacatactagaaatttgaagctcagttccttgggctctagagactccagcacagaggcccataggagggccatgaaaatggtgatgtctttccttttcctcttcatagttcattttttttccttacaagtggccaatgggatattttttatgttgtggaacaacaagtacataaagtttgtcatgttagccttaaatgcctttccctcgtgccactcatttattctcattctgggaaacagcaagctgcgacagacagctgtgaggctactgtggcatcttaggaactatacaaaaacaccaaatgctttacctttgtag

SEQ ID NO: 31028 - DNA, 1027 bp, Homo sapiens
tcagcgagaccacgaacccacctgcaggaaccaattccggacacaacaccagcatttaaaaaaattttttttgtctgttcagacatgataacttttctacccatcattttttccagtctggtagtggttacatttgttattggaaattttgctaatggcttcatagcactggtaaattccattgagtggttcaagagacaaaagatctcctttgctgaccaaattctcactgctctggcggtctccagagttggtttgctctgggtattattattaaactggtattcaactgtgttgaatccagcttttaatagtgtagaagtaagaactactgcttataatatctgggcagtgatcaaccatttcagcaactggcttgctactaccctcagcatattttatttgctcaagattgccaatttctccaactttatttttcttcacttaaagaggagagttaagagtgtcattctggtgatgttgttggggcctttgctatttttggcttgtcatctttttgtgataaacatgaatgagattgtgcggacaaaagaatttgaaggaaacatgacttggaagatcaaattgaagagtgcaatgtacttttcaaatatgactgtaaccatggtagcaaacttagtacccttcactctgaccctactatcttttatgctgttaatctgttctttgtgtaaacatctcaagaagatgcagctccatggtaaaggatctcaagatcccagcaccaaggtccacataaaagctttgcaaactgtgatctccttcctcttgttatgtgccatttactttctgtccataatgatatcagtttggagttttggaagtctggaaaacaaacctgtcttcatgttctgcaaagctattagattcagctatccttcaatccacccattcatcctgatttggggaaacaagaagctaaagcagacttttctttcagttttttggcaaatgaggtactgggtgaaaggagagaagacttcatctccatagattcacgagaggg

SEQ ID NO: 31029 - DNA, 930 bp, Homo sapiens
atgataacttttctgcccatcattttttccattctaatagtggttacatttgtgattggaaattttgctaatggcttcatagcattggtaaattccattgagtggttcaagagacaaaagatctcttttgctgaccaaattctcactgctctggcagtctccagagttggtttactctgggtattagtattaaattggtatgcaactgagttgaatccagcttttaacagtatagaagtaagaattactgcttacaatgtctgggcagtaatcaaccatttcagcaactggcttgctactagcctcagcatattttatttgctcaagattgccaatttctccaaccttatttttcttcacttaaagaggagagttaagagtgttgttctggtgatactattggggcctttgctatttttggtttgtcatctttttgtgataaacatgaatcagattatatggacaaaagaatatgaaggaaacatgacttggaagatcaaactgaggagtgcaatgtacctttcaaatacaacggtaaccatcctagcaaacttagttcccttcactctgaccctgatatcttttctgctgttaatctgttctctgtgtaaacatctcaaaaagatgcagctccatggcaaaggatctcaagatcccagcatgaaggtccacataaaagctttgcaaactgtgacctccttcctcttgttatgtgccatttactttctgtccataatcatgtcagtttggagttttgagagtctggaaaacaaacctgtcttcatgttctgcgaagctattgcattcagctatccttcaacccacccattcatcctgatttggggaaacaagaagctaaagcagacttttctttcagttttgtggcatgtgaggtactgggtgaaaggagagaagccttcatcttcatag

SEQ ID NO: 31030 - DNA, 1150 bp, Homo sapiens
cagctgttcagtctcgcttgaagacagattacggaaggacgaggccaaatccagattttgtggtgtgaaaatttaccctggtgtgttatcactaccaggggatctgacctcagccaggagcagtgagagcctcctctccccagccatgctgagcgctggcctaggactgctgatgctggtggcagtggttgaatttctcatcggtttaattggaaatggaagcctggtggtctggagttttagagaatggatcagaaaattcaactggtcctcatataacctcattatcctgggcctggctggctgccgatttctcctgcagtggctgatcattttggacttaagcttgtttccacttttccagagcagccgttggcttcgctatcttagtatcttctgggtcctggtaagccaggccagcttatggtttgccaccttcctcagtgtcttctattgcaagaagatcacgaccttcgatcgcccggcctacttgtggctgaagcagagggcctataacctgagtctctggtgccttctgggctactttataatcaatttgttacttacagtccaaattggcttaacattctatcatcctccccaaggaaacagcagcattcggtatccctttgaaagctggcagtacctgtatgcatttcagctcaattcaggaagttatttgcctttagtggtgtttcttgtttcctctgggatgctgattgtctctttgtatacacaccacaagaagatgaaggtccattcagctggtaggagggatgtccgggccaaggctcacatcactgcgctgaagtccttgggctgcttcctcttacttcacctggtttatatcatggccagccccttctccatcacctccaagacttatcctcctgatctcaccagtgtcttcatctgggagacactcatggcagcctatccttctcttcattctctcatattgatcatggggattcctagggtgaagcagacttgtcagaagatcctgtggaagacagtgtgtgctcggagatgctggggcccatgatctgggaagaaaagtgtggtcaggacactcttgggacgctcttttgatagctctctataagggagctgctttccatgtcttttaagattttccttcttttacacc

SEQ ID NO: 31031 - DNA, 1000 bp, Homo sapiens
tcacaaccagtgatattaggcttgcattttctttctttttttctgctcagatatgataacttttctatacatttttttttcaattctaataatggttttatttgttctcggaaactttgccaatggcttcatagcactggtaaatttcattgactgggtgaagagaaaaaagatctcctcagctgaccaaattctcactgctctggcggtctccagaattggtttgctctgggcattattattaaattggtatttaactgtgttgaatccagctttttatagtgtagaattaagaattacttcttataatgcctgggttgtaaccaaccatttcagcatgtggcttgctgctaacctcagcatattttatttgctcaagattgccaatttctccaaccttctttttcttcatttaaagaggagagttaggagtgtcattctggtgatactgttggggactttgatatttttggtttgtcatcttcttgtggcaaacatggatgagagtatgtgggcagaagaatatgaaggaaacatgactgggaagatgaaattgaggaatacagtacatctttcatatttgactgtaactaccctatggagcttcataccctttactctgtccctgatatcttttctgatgctaatctgttctctgtgtaaacatctcaagaagatgcagctccatggagaaggatcgcaagatctcagcaccaaggtccacataaaagctttgcaaactctgatctccttcctcttgttatgtgccattttctttctattcctaatcgtttcggtttggagtcctaggaggctgcggaatgacccggttgtcatggttagcaaggctgttggaaacatatatcttgcattcgactcattcatcctaatttggagaaccaagaagctaaaacacacctttcttttgattttgtgtcagattaggtgctgagtaaaagacctgaaactctcaactctctagattcacaagtgggacatt

SEQ ID NO: 31032 - DNA, 957 bp, Homo sapiens
atgaatggagaccacatggttctaggatcttcggtgactgacaagaaggccatcatcttggttaccattttactccttttacgcctggtagcaatagcaggcaatggcttcatcactgctgctctgggcgtggagtgggtgctacggagaatgttgttgccttgtgataagttattggttagcctaggggcctctcgcttctgtctgcagtcagtggtaatgggtaagaccatttatgttttcttgcatccgatggccttcccatacaaccctgtactgcagtttctagctttccagtgggacttcctgaatgctgccaccttatggtcctctacctggctcagtgtcttctattgtgtgaaaattgctaccttcacccaccctgtcttcttctggctaaagcacaagttgtctgggtggctaccatggatgctcttcagctctgtagggctctccagcttcaccaccattctatttttcataggcaaccacagaatgtatcagaactatttaaggaaccatctacaaccttggaatgtcactggcgatagcatacggagctactgtgagaaattctatctcttccctctaaaaatgattacttggacaatgcccactgctgtctttttcatttgcatgattttgctcatcacatctctgggaagacacaggaagaaggctctccttacaacctcaggattccgagagcccagtgtgcaggcacacataaaggctctgctggctctcctctcttttgccatgctcttcatctcatatttcctgtcactggtgttcagtgctgcaggtatttttccacctctggactttaaattctgggtgtgggagtcagtgatttatctgtgtgcagcagttcaccccatcattctgctcttcagcaactgcaggctgagagctgtgctgaagagtcgtcgttcctcaaggtgtgggacaccttga

SEQ ID NO: 31033 - DNA, 1844 bp, Homo sapiens
ggcaggttcgctgtggcgggcgcctgggccgccggctgtttaacttcgcttccgctggcccatagtgatctttgcagtgacccagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaa

SEQ ID NO: 31034 - DNA, 1453 bp, Homo sapiens
aggttcgctgtggcgggcgcctgggccgccggctgtttaacttcgcttccgctggcccatagtgatctttgcagtgacccagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagatt

SEQ ID NO: 31035 - DNA, 1903 bp, Homo sapiens
ggcggaagtgacattatcaacgcgcgccaggggttcagtgaggtcgggcaggttcgctgtggcgggcgcctgggccgccggctgtttaacttcgcttccgctggcccatagtgatctttgcagtgacccagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttagattgttgtt

SEQ ID NO: 31036 - DNA, 935 bp, Homo sapiens
ggagcaactcgctgaagccgagggcagaactggcggaagtgacattatcaacgcgcgccaggggttcagtgaggtcgggcaggttcgctgtggcgggcgcctgggccgccggctgtttaacttcgcttccgctggcccatagtgatctttgcagtgacccagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaa

SEQ ID NO: 31037 - DNA, 703 bp, Homo sapiens
gttccggcctgtaacggccactcggccgccactcccgcctggtgccctactctgctgtgtttcgcaggcagcttcccatcgtacgattgtggggctcaggcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcc

SEQ ID NO: 31038 - DNA, 892 bp, Homo sapiens
tgaagaacagtccagactggcagcaagaaaatatgctagagttgtacagaagttgggttttccagctaagttcttggacttcaagattcagaatatggtggggagctgtgatgtgaagtttcctataagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaa

SEQ ID NO: 31039 - DNA, 1701 bp, Homo sapiens
ggcggaagtgacattatcaacgcgcgccaggggttcagtgaggtcgggcaggttcgctgtggcgggcgcctgggccgccggctgtttaacttcgcttccgctggcccatagtgatctttgcagtgacccagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttagattgttgtt

SEQ ID NO: 31040 - DNA, 3879 bp, Homo sapiens
cccgagtgccaaagctggggttctacttgagatttccctcgtggtgccagggtccggcgagcatcacgccgaggcccattttccagacgaccacgacgaggccggggtcacgaactctggcgccccttaccagcttccagtctctcgaggtggccagtgtggtgcttggtccttgtttccaggatggacttccccagctccctccgccctgcattgtttctgaccggcccccttggtctgagcgacgtccctgacctctctttcatgtgcagctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtgccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaagtaaggcccttatatacactttcctccctcactggctgacctgctacctgacccctggccctttccatccctcctcagctctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccttggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttatgattaaaccatttatgctacata

SEQ ID NO: 31041 - DNA, 1911 bp, Homo sapiens
gagccgggccgcgcgctgcctaaatacctaaaccaggtttagcgcctgctcatataaagctctcctaactcgtcttccggtgggaatttcttcacgtgggccggagtcggagactgagtttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggccattggagggaaaaggaggaaggattttgctcagacaacaagtgcttgtttaagttttatccaagaagctctgctgaagcaccaatggcagcaagctgcagaatacatgtacagttattttcagaccttggaagattcagatagctacaaaaggcaggctgcacctgagattatttggaagctcggaagtgaaattctattttatcatcccaaaagcaacatggagagtttcaatacttttgctaaccggatgaaaaatattggcgtcatgaattatttaaagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagattttgtatcagattgtaccatctcataaattgatgttggaattccatacattacttagaaaatcagaaaaagaagaacaccgtaaactggggttggaggtattatttggagtcttagattttgccggatgcactaagaatataactgcttggaaatacttggcaaaatatctgaaaaatatcttaatgggaaaccaccttgcgtgggttcaagaagagtggaactccaggaaaaactggtggccaggctttcatttcagctacttttgggcaaaaagtgattggaaggaagatacagctttggcctgtgagaaagcttttgtggctggtttactgttaggaaaaggttgtagatatttccggtatattttaaagcaagatcaccaaatcttagggaagaaaattaagcggatgaagagatctgtgaaaaaatacagtattgtaaatccaagactctgatactgaattttagttatttcacagttgtagctacacagtataccaccatgaagaaatatattggtgatgagttctattgaggaattttgaaaagagagaaggatttagaaaaaagactctttctcggccgggcgcagtggctcacacttctaatcccagcacttgggaggccgaggtgggtggatcatgaggtcaggagttcaagaccagcctggccaacacagtgaaaccctgtctctactaaaaatacaaaaagtagctgggcgcagtggcgggcatttgtaatcccagatactcgggaggctgaagcaggagaattgcttgaacccgggaggtggaggttgcagtgagccgagattgcaccaccgtactcctgcctgggcgacagaactagactctgtctc

SEQ ID NO: 31042 - DNA, 1894 bp, Homo sapiens
gccaacgatacgcctgctgcagcaggaggagttacgagccgggccgcgcgctgcctaaatacctaaaccaggtttagcgcctgctcatataaagctctcctaactcgtcttccggtgggaatttcttcacgtgggccggagtcggagactgagtttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggccattggagggaaaaggaggaaggattttgctcagacaacaagtgcttgtttaagttttatccaagaagctctgctgaagcaccaatggcagcaagctgcagaatacatgtacagttattttcagaccttggaagattcagatagctacaaaaggcaggctgcacctgagattatttggaagctcggaagtgaaattctattttatcatcccaaaagcaacatggagagtttcaatacttttgctaaccggatgaaaaatattggcgtcatgaattatttaaagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagattttgtatcagattgtaccatctcataaattgatgttggaattccatacattacttagaaaatcagaaaaagaagaacaccgtaaactggggttggaggtattatttggagtcttagattttgccggatgcactaagaatataactgcttggaaatacttggcaaaatatctgaaaaatatcttaatgggaaaccaccttgcgtgggttcaagaagagtggaactccaggaaaaactggtggccaggctttcatttcagctacttttgggcaaaaagtgattggaaggaagatacagctttggcctgtgagaaagcttttgtggctggtttactgttaggaaaaggttgtagatatttccggtatattttaaagcaagatcaccaaatcttagggaagaaaattaagcggatgaagagatctgtgaaaaaatacagtattgtaaatccaagactctgatactgaattttagttatttcacagttgtagctacacagtaagtagcttggtagatagttattgaatgtatttatgtagtgtattaagaagcttatattactacaaaaaacttatttttatatatttttatatttttgtattatttatagctagagaaacaatattactgcctttgctctttgtaactatgtctgttttcttttttgtaatgttaaatgttacatttgttaaggaataattcttcaaatgacaaactaattacagaatatagctctacagcagttattgtttgcaaatactttgcctcttgctattgtgtaataaactgtaacttgtagtgctgtgaaatgta

SEQ ID NO: 31043 - DNA, 1648 bp, Homo sapiens
acgtgggccggagtcggagactgagtttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggattatttggaagctcggaagtgaaattctattttatcatcccaaaagcaacatggagagtttcaatacttttgctaaccggatgaaaaatattggcgtcatgaattatttaaagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagattttgtatcagattgtaccatctcataaattgatgttggaattccatacattacttagaaaatcagaaaaagaagaacaccgtaaactggggttggaggtattatttggagtcttagattttgccggatgcactaagaatataactgcttggaaatacttggcaaaatatctgaaaaatatcttaatgggaaaccaccttgcgtgggttcaagaagagtggaactccaggaaaaactggtggccaggctttcatttcagctacttttgggcaaaaagtgattggaaggaagatacagctttggcctgtgagaaagcttttgtggctggtttactgttaggaaaaggttgtagatatttccggtatattttaaagcaagatcaccaaatcttagggaagaaaattaagcggatgaagagatctgtgaaaaaatacagtattgtaaatccaagactctgatactgaattttagttatttcacagttgtagctacacagtataccaccatgaagaaatatattggtgatgagttctattgaggaattttgaaaagagagaaggatttagaaaaaagactctttctcggccgggcgcagtggctcacacttctaatcccagcacttgggaggccgaggtgggtggatcatgaggtcaggagttcaagaccagcctggccaacacagtgaaaccctgtctctactaaaaatacaaaaagtagctgggcgcagtggcgggcatttgtaatcccagatactcgggaggctgaagcaggagaattgcttgaacccgggaggtggaggttgcagtgagccgagattgcaccaccgtactcctgcctgggcgacagaactagactctgtctc

SEQ ID NO: 31044 - DNA, 1708 bp, Homo sapiens
gccaacgatacgcctgctgcagcaggaggagttacgagccgggccgcgcgctgcctaaatacctaaaccaggtttagcgcctgctcatataaagctctcctaactcgtcttccggtgggaatttcttcacgtgggccggagtcggagactgagtttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggattatttggaagctcggaagtgaaattctattttatcatcccaaaagcaacatggagagtttcaatacttttgctaaccggatgaaaaatattggcgtcatgaattatttaaagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagattttgtatcagattgtaccatctcataaattgatgttggaattccatacattacttagaaaatcagaaaaagaagaacaccgtaaactggggttggaggtattatttggagtcttagattttgccggatgcactaagaatataactgcttggaaatacttggcaaaatatctgaaaaatatcttaatgggaaaccaccttgcgtgggttcaagaagagtggaactccaggaaaaactggtggccaggctttcatttcagctacttttgggcaaaaagtgattggaaggaagatacagctttggcctgtgagaaagcttttgtggctggtttactgttaggaaaaggttgtagatatttccggtatattttaaagcaagatcaccaaatcttagggaagaaaattaagcggatgaagagatctgtgaaaaaatacagtattgtaaatccaagactctgatactgaattttagttatttcacagttgtagctacacagtaagtagcttggtagatagttattgaatgtatttatgtagtgtattaagaagcttatattactacaaaaaacttatttttatatatttttatatttttgtattatttatagctagagaaacaatattactgcctttgctctttgtaactatgtctgttttcttttttgtaatgttaaatgttacatttgttaaggaataattcttcaaatgacaaactaattacagaatatagctctacagcagttattgtttgcaaatactttgcctcttgctattgtgtaataaactgtaacttgt

SEQ ID NO: 31045 - DNA, 894 bp, Homo sapiens
ttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggccattggagggaaaaggaggaaggattttgctcagacaacaagtgcttgtttaagttttatccaagaagctctgctgaagcaccaatggcagcaagctgcagaatacatgtacagttattttcagaccttggaagattcagatagctacaaaaggcaggctgcacctgagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagattttgtatcagattgtaccatctcataaattgatgttggaattccatacattacttagaaaatcagaaaaagaagaac

SEQ ID NO: 31046 - DNA, 1764 bp, Homo sapiens
gccaacgatacgcctgctgcagcaggaggagttacgagccgggccgcgcgctgcctaaatacctaaaccaggtttagcgcctgctcatataaagctctcctaactcgtcttccggtgggaatttcttcacgtgggccggagtcggagactgagtttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggccattggagggaaaaggaggaaggattttgctcagacaacaagtgcttgtttaagttttatccaagaagctctgctgaagcaccaatggcagcaagctgcagaatacatgtacagttattttcagaccttggaagattcagatagctacaaaaggcaggctgcacctgagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagattttgtatcagattgtaccatctcataaattgatgttggaattccatacattacttagaaaatcagaaaaagaagaacaccgtaaactggggttggaggtattatttggagtcttagattttgccggatgcactaagaatataactgcttggaaatacttggcaaaatatctgaaaaatatcttaatgggaaaccaccttgcgtgggttcaagaagagtggaactccaggaaaaactggtggccaggctttcatttcagctacttttgggcaaaaagtgattggaaggaagatacagctttggcctgtgagaaagcttttgtggctggtttactgttaggaaaaggttgtagatatttccggtatattttaaagcaagatcaccaaatcttagggaagaaaattaagcggatgaagagatctgtgaaaaaatacagtattgtaaatccaagactctgatactgaattttagttatttcacagttgtagctacacagtaagtagcttggtagatagttattgaatgtatttatgtagtgtattaagaagcttatattactacaaaaaacttatttttatatatttttatatttttgtattatttatagctagagaaacaatattactgcctttgctctttgtaactatgtctgttttcttttttgtaatgttaaatgttacatttgttaaggaataattcttcaaatgacaaactaattacagaatatagctctacagcagttattgtttgcaaatactttgcctcttgctattgtgtaataaactgtaacttgt

SEQ ID NO: 31047 - DNA, 1235 bp, Homo sapiens
acttccggggtcgaggcgaggccaacgatacgcctgctgcagcaggaggagttacgagccgggccgcgcgctgcctaaatacctaaaccaggtttagcgcctgctcatataaagctctcctaactcgtcttccggtgggaatttcttcacgtgggccggagtcggagactgagtttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggccattggagggaaaaggaggaaggattttgctcagacaacaagtgcttgtttaagttttatccaagaagctctgctgaagcaccaatggcagcaagctgcagaatacatgtacagttattttcagaccttggaagattcagatagctacaaaaggcaggctgcacctgagattatttggaagctcggaagtgaaattctattttatcatcccaaaagcaacatggagagtttcaatacttttgctaaccggatgaaaaatattggcgtcatgaattatttaaagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagcatctacagaaaatttcaataatgtacagtacactgagataaacagagaaagttggctccagctgccatctccatgtatgtatcatccacactatcccctgctgcccggatgagactgaggagagaggatca

SEQ ID NO: 31048 - DNA, 3679 bp, Homo sapiens
gtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtgccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccttggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttatgattaaaccatttatgctac

SEQ ID NO: 31049 - DNA, 3693 bp, Homo sapiens
atggacttccccagctccctccgccctgcattgtttctgaccggcccccttggtctgagcgacgtccctgacctctctttcatgtgcagctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtgccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaagtaaggcccttatatacactttcctccctcactggctgacctgctacctgacccctggccctttccatccctcctcagctctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccttggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttatgattaaaccatttatgctac

SEQ ID NO: 31050 - DNA, 1318 bp, Homo sapiens
ctacttgagatttccctcgtggtgccagggtccggcgagcatcacgccgaggcccattttccagacgaccacgacgaggccggggtcactgcattttctgggaggcactgtgcttgacagtaggaagacgatgctcagatgcagtccctggctgtggagtaacttgagcgtcttgggggtgtagtctgtaaatgatggacttccccagctccctccgccctgcattgtttctgaccggcccccttggtctgagcgacgtccctgacctctctttcatgtgcagctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtgccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggtatcgccgcttcctgtgaaaccccccaccctaacgaactgaactccgccctgttgagcatgtcgcgacccttgagccccttccccatcagcctgt

SEQ ID NO: 31051 - DNA, 3682 bp, Homo sapiens
gtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtgccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccttggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttatgattaaaccatttatgctac

SEQ ID NO: 31052 - DNA, 2747 bp, Homo sapiens
gtgggtagctgcggcggggctgacccgtcccgagtgccaaagctggggttctacttgagatttccctcgtggtgccagggtccggcgagcatcacgccgaggcccattttccagacgaccacgacgaggccggggtcacatccctgggaccctggcctgactgcccgggacctgcttttccgcggagggtgccggtatcggaagcggccccgagtcgtgctggatgtgactgagcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggtatcgccgcttcctgtgaaaccccccaccctaacgaactgaactccgccctgttgagcatgtcgcgacccttgagccccttccccatcagcctgtccccctgcccacggcttgcctgtctccccaaggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagatggtcactagaggctgctgcttaccagcggctctgctgggcccagacaaccacccagcaaaccaaactcaaccctggatgaatctgtggcccaaacacgcagtggatcccacagtcggtgctaacagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgt

SEQ ID NO: 31053 - DNA, 2540 bp, Homo sapiens
cttttcttccgcacggttggaggaggtcggctggttatcgggagttggagggctgaggtcgggagggtggtgtgtacagagctctaggacaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatggcaagtaatggtttttatcttaactataagttatttgctcaagggtgtaatggtcattaccaaggcttttagaatgcagtttctcatttgctgtggacatgaccataaaaaaatttcccagtaggttttctatctgctactttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccatagcactcctaatgtttggtgctatgttttcctgaggagatataaaacgtaataatccaggattgttgccatgtgagagttttaaaggttaatcaaaatttctcttcttcagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttcagttgtgtacttcatgcttgaaaaattaagtccttctccctcagttatactcaccttatggaattcttttgcccttgctctgttttgggcataagcttcttgttttgttttttcttccttttgttgtttcacttcagctagttgattgtataacctgtaaagaatttatatagaattagagacaaacactgcaaaaagtgaatcactaaaaaaaaaaaaaaaattaaccctaccttagacccctttggtgcctta

SEQ ID NO: 31054 - DNA, 2082 bp, Homo sapiens
caaaggattacaaaacactcaggcacacatcccacccgtcaccctcgccacacacccgggaccagatttagaaagccaggcgacagctcagcaaacgcgagaccaccggaaacgaaccgggctgagaggctgtttcctcacagttctcatccactcacaagtgaccgcacgttttgtttttgttatttgccgaaatgttcttggctattccactcacctaaacggtcacggtagcaaaacacccagagtccggatcttcgcctaggccaaccccgcctcctcagaatacgcgagctagagctccgcccacgttagtcagtcctccctgcgcggcgagaaaaatggcgcccccacgtcgcgtctcctcccaccgctcgccttcttcccggaagctaagttgtatcgcgagatttcggcctgactattacttgggccacggaaatagccaacccttttcttccgcacggttggaggaggtcggctggttatcgggagttggagggctgaggtcgggagggtggtgtgtacagagctctaggacaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggtgaagcatatagaaaaaacgacttcatagaaatgaataaagataaatgtggatatatgtaccagtctggtggtgaagaaattctgaaacccagaactttataacaagaaaaaaaatttttaaccctgtgaagaagtttgtgaaagaaacttgtgaagtagtaataattagaaaaaaaaccattaaaacaccagagaaaatacatagaaaaatttgagaaattgtcatttgatttctgaataagagcttacaggtgtcctgtgagtattgaaacaatgaaatgtagtgattttaattttgaaaagaaaatcttaaagtaacttgacacccaaccatcttgaagaggggatttgaaatgctgtaattttatcccagctttgttcagccatgacaagtgacctgtcagatgcttagtattgtaataacctcatttccctttccaaatttagagtatctttaatactattttttttagacagagtctcgatctgtcacccaggctgtagtgcaatggccgcagtcttggcttactgcaacctccatctcccgggttcaagcgattctgcctcagcct

SEQ ID NO: 31055 - DNA, 1735 bp, Homo sapiens
ttttcttccgcacggttggaggaggtcggctggttatcgggagttggagggctgaggtcgggagggtggtgtgtacagagctctaggacaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggactattgttagatctgtgggaaggaattacaagacagttgctaaaagtttgaaaaagacggttgctaaacgttatgaaaaaccagataatctacttttttaccttaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttcagttgtgta

SEQ ID NO: 31056 - DNA, 335 bp, Homo sapiens
cctcgggaaaccgaacgcaacgctcagactggaaacaaaggagctggcccagcaactttcccagaacgcaccgcaagctccctcctcgggacgctgcattttcattttgcattgagcctcacaaattacacagctaggcttgctgctgaatacggcagtgagggacatgccataccagtcctggagcttcgtcattgcccagaccctgtggatcaaatgcagtgggctgcctaaaggatcggactttttatccccggaattgtccaaactatggagcaaagcagaaaactgtttaaaacaaagagcaattgatggataaatcaggaatagattct

SEQ ID NO: 31057 - DNA, 6625 bp, Homo sapiens
gtagatttggttgctgtgtacgtggaagaagcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttccacaccaataaatgaaggacagactgtgttagacaaggtggctgagcagtgtgaacctgctgaaagtcagccagaagcactttctgagaaggaagatgtttgcaaggtaactctaacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacagctagaaattggcaatctagaaaaaactcgatcaataatggctgaagaactagttaaattaacaaatcaaaatgatgaacttgaagagaaggtgaaggagatacccaaacttagaactcagctaagagatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcagttaacttgtgaaaattgaattcccatcaaactgaatgtaagcatttaatatctaaacatttaatgtggacttccaataaattcttttatagaattagaaagtgggatttactgtagagtgtaaaaatttttttaaaattgttttacactatgtagtaatatttacagttaaattattttgtgcaatatttgaactttatttttgaaactattctttaaagatttattttttaaagcattcattttttttccttgaatagcacagagatttattactttatcctcatataaatatggctagagaagaagaatggtgttcatatatgtattgtagatatacaactagttgtatctataatttgtaagtgtttatatatatattaagaacatttgaagagtaatgttaacatactgaaactttgaaatctttcacatttaaaatttcaacatatcttaattactgctcatgaaaatgtacattaagtgttaaagtaaaaaattattaaatctgtggctattaaattttaaactaatttttttcctttaaaagtaagagtcacactgacactgtctgaaatttaaagagtgaatgatttaaacttaaaaaaaattttgatctgaaaatttatttcacccagctttcacaattaagtctgtataaaatgtggtaccttttggtacctatccagagaaacctgtacatattcaatgttatctagatgtgattggataatggagaaaatttatttataatgattttgcaatggcatcaataacatttaaatgattttgaagaagtattattttactaccctataaaatgaatcgaaaataataaagttcttaacataatttactctttaaaaattacctgttcatattttgtaaacccatatttttagcacattaaaaatgaatgtttgatattacagaatattcataacaaaatggaagaattataggaattaacttgaatttggcatttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaaccccatctctactaaaaatacaaaaattagcctggcgtggtggtgtgcgcctgtaatcctagctactcgggaggctgaggcaggagcattgcttgaacctgggaggtggaggttacaatgagccaagattgtgccactgcactccagcatgggtgacagagaaagactccgtctcaaaaaaaaaaaaacaaactcttatttaatttttagttaaaattaaaacactagtacttcagaatatagatacaagtacaccatcttgaagaatttggagtttttcagggcaattcaaatgacctcattttttgttctttttgtattccagacagtgtttctgtcattggatctctgattggtagtgttaataaatattctttcagtgtgagccagattcataaaattaattttcttcattttagtagtaaaaagtagtctaatagctttttgtcagcttgatttttttgtgtgtgtaatattcaagggcagaatgacaggacagataagcaataagaaatgtatagaattagaaaatatagtagttccctcttacccatgggacatacgttccaagacccccagtgaacgtctgaaaccatggatagtatagacacctctatacactgttttttcctatacatatatacctatgataaagttctatttataaatcagggacagcaagagataaacaataactgcaaatagaacaattataacagtgcactgtaataaaagtgatgtaaatgtgatatgtctgtctctttctctcaaaatatcttattgtactgtactcacctgtaatcagactgtggttgaccgtgagtaaccgaaaccacagaaagcaaaatcgtggataaggggagactactctatatgaaacttaagttacaaaattctctgaagcatttgaaactagacgttttggaattataaaatagtccctttaaaatatccactagtagaaaaaaacttcatttgcagagaaaagattgcaataaaactcattcctaaacttttcaattttataaaattaaacattctttttttatccgtattaacaatttctagttacatagtttctagttacatattaccatatattactctttatctacaaataaatagctgatactcaaactgatcatattttgattgttaaacacttggatctctcaatacttctgtaagttaaagtgaacttaaacagtttcttgaaaaactccagtaggtggcagaatacctattgaatattcgttgctatactttgctgtttgtcattaaaacatctctacccatattcttgcaaaataatatttatattttaatggataggaaaatgatttgcaattagatgtttccattcttgaaagaaaaaagctgcaaataacattttcaagaatataaaaaaatgagtaaacaaagggaaggttgtttggtcatttatagacaattaagcacagactgtagatgtccttccaattcttgggaggctaaactgagtctaccatttcttacatttcttttacctattttttgagaattgccagttgtacagtgtttagcatgtggaatgtaccaaatatatctatgttgtgacttaagatattctaaatgtggataacttctgacctaggaaacatgaagtttgtagtgaagtaagtgaaaagaatgttcaggaaattttttttctccatctcttcagttggcatttattgagagttttatttgaatgcttattaaaagtatatgatttataatatttagaaaatagaagaaaaaagaaaactgtagatgttttatcttgttttaatactgtatgtttagtacgtatacatttatgttctagtgtatcaaaatttttcattttcattaaagtgaatccaattttccatattctaggtccattttaaaccatgaaaactttaatcacatattttgtaaagggctgaaagtatgatttaaactacagattgatatattttaattctaaatgaaaggtaatgtaaataagcatggatctgattgaataaagattttaaaatagt

SEQ ID NO: 31058 - DNA, 6849 bp, Homo sapiens
gcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttccacaccaataaatgaaggacagactgtgttagacaaggtggctgagcagtgtgaacctgctgaaagtcagccagaagcactttctgagaaggaagatgtttgcaagacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacagctagaaattggcaatctagaaaaaactcgatcaataatggctgaagaactagttaaattaacaaatcaaaatgatgaacttgaagagaaggtgaaggagatacccaaacttagaactcagctaagagatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcagttaacttgtgaaaattgaattcccatcaaactgaatgtaagcatttaatatctaaacatttaatgtggacttccaataaattcttttatagaattagaaagtgggatttactgtagagtgtaaaaatttttttaaaattgttttacactatgtagtaatatttacagttaaattattttgtgcaatatttgaactttatttttgaaactattctttaaagatttattttttaaagcattcattttttttccttgaatagcacagagatttattactttatcctcatataaatatggctagagaagaagaatggtgttcatatatgtattgtagatatacaactagttgtatctataatttgtaagtgtttatatatatattaagaacatttgaagagtaatgttaacatactgaaactttgaaatctttcacatttaaaatttcaacatatcttaattactgctcatgaaaatgtacattaagtgttaaagtaaaaaattattaaatctgtggctattaaattttaaactaatttttttcctttaaaagtaagagtcacactgacactgtctgaaatttaaagagtgaatgatttaaacttaaaaaaaattttgatctgaaaatttatttcacccagctttcacaattaagtctgtataaaatgtggtaccttttggtacctatccagagaaacctgtacatattcaatgttatctagatgtgattggataatggagaaaatttatttataatgattttgcaatggcatcaataacatttaaatgattttgaagaagtattattttactaccctataaaatgaatcgaaaataataaagttcttaacataatttactctttaaaaattacctgttcatattttgtaaacccatatttttagcacattaaaaatgaatgtttgatattacagaatattcataacaaaatggaagaattataggaattaacttgaatttggcatttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaaccccatctctactaaaaatacaaaaattagcctggcgtggtggtgtgcgcctgtaatcctagctactcgggaggctgaggcaggagcattgcttgaacctgggaggtggaggttacaatgagccaagattgtgccactgcactccagcatgggtgacagagaaagactccgtctcaaaaaaaaaaaaacaaactcttatttaatttttagttaaaattaaaacactagtacttcagaatatagatacaagtacaccatcttgaagaatttggagtttttcagggcaattcaaatgacctcattttttgttctttttgtattccagacagtgtttctgtcattggatctctgattggtagtgttaataaatattctttcagtgtgagccagattcataaaattaattttcttcattttagtagtaaaaagtagtctaatagctttttgtcagcttgatttttttgtgtgtgtaatattcaagggcagaatgacaggacagataagcaataagaaatgtatagaattagaaaatatagtagttccctcttacccatgggacatacgttccaagacccccagtgaacgtctgaaaccatggatagtatagacacctctatacactgttttttcctatacatatatacctatgataaagttctatttataaatcagggacagcaagagataaacaataactgcaaatagaacaattataacagtgcactgtaataaaagtgatgtaaatgtgatatgtctgtctctttctctcaaaatatcttattgtactgtactcacctgtaatcagactgtggttgaccgtgagtaaccgaaaccacagaaagcaaaatcgtggataaggggagactactctatatgaaacttaagttacaaaattctctgaagcatttgaaactagacgttttggaattataaaatagtccctttaaaatatccactagtagaaaaaaacttcatttgcagagaaaagattgcaataaaactcattcctaaacttttcaattttataaaattaaacattctttttttatccgtattaacaatttctagttacatagtttctagttacatattaccatatattactctttatctacaaataaatagctgatactcaaactgatcatattttgattgttaaacacttggatctctcaatacttctgtaagttaaagtgaacttaaacagtttcttgaaaaactccagtaggtggcagaatacctattgaatattcgttgctatactttgctgtttgtcattaaaacatctctacccatattcttgcaaaataatatttatattttaatggataggaaaatgatttgcaattagatgtttccattcttgaaagaaaaaagctgcaaataacattttcaagaatataaaaaaatgagtaaacaaagggaaggttgtttggtcatttatagacaattaagcacagactgtagatgtccttccaattcttgggaggctaaactgagtctaccatttcttacatttcttttacctattttttgagaattgccagttgtacagtgtttagcatgtggaatgtaccaaatatatctatgttgtgacttaagatattctaaatgtggataacttctgacctaggaaacatgaagtttgtagtgaagtaagtgaaaagaatgttcaggaaattttttttctccatctcttcagttggcatttattgagagttttatttgaatgcttattaaaagtatatgatttataatatttagaaaatagaagaaaaaagaaaactgtagatgttttatcttgttttaatactgtatgtttagtacgtatacatttatgttctagtgtatcaaaatttttcattttcattaaagtgaatccaattttccatattctaggtccattttaaaccatgaaaactttaatcacatattttgtaaagggctgaaagtatgatttaaactacagattgatatattttaattctaaatgaaaggtaatgtaaataagcatggatctgattgaataaagattttaaaatagtaa

SEQ ID NO: 31059 - DNA, 1846 bp, Homo sapiens
gtagatttggttgctgtgtacgtggaagaagcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttccacaccaataaatgaaggacagactgtgttagacaaggtggctgagcagtgtgaacctgctgaaagtcagccagaagcactttctgagaaggaagatgtttgcaagacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaagtaaaaagaaaaaaaaga

SEQ ID NO: 31060 - DNA, 6886 bp, Homo sapiens
gtagatttggttgctgtgtacgtggaagaagcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttccacaccaataaatgaaggacagactgtgttagacaaggtggctgagcagtgtgaacctgctgaaagtcagccagaagcactttctgagaaggaagatgtttgcaaggtaactctaacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacagctagaaattggcaatctagaaaaaactcgatcaataatggctgaagaactagttaaattaacaaatcaaaatgatgaacttgaagagaaggtgaaggagatacccaaacttagaactcagctaagagatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcagttaacttgtgaaaattgaattcccatcaaactgaatgtaagcatttaatatctaaacatttaatgtggacttccaataaattcttttatagaattagaaagtgggatttactgtagagtgtaaaaatttttttaaaattgttttacactatgtagtaatatttacagttaaattattttgtgcaatatttgaactttatttttgaaactattctttaaagatttattttttaaagcattcattttttttccttgaatagcacagagatttattactttatcctcatataaatatggctagagaagaagaatggtgttcatatatgtattgtagatatacaactagttgtatctataatttgtaagtgtttatatatatattaagaacatttgaagagtaatgttaacatactgaaactttgaaatctttcacatttaaaatttcaacatatcttaattactgctcatgaaaatgtacattaagtgttaaagtaaaaaattattaaatctgtggctattaaattttaaactaatttttttcctttaaaagtaagagtcacactgacactgtctgaaatttaaagagtgaatgatttaaacttaaaaaaaattttgatctgaaaatttatttcacccagctttcacaattaagtctgtataaaatgtggtaccttttggtacctatccagagaaacctgtacatattcaatgttatctagatgtgattggataatggagaaaatttatttataatgattttgcaatggcatcaataacatttaaatgattttgaagaagtattattttactaccctataaaatgaatcgaaaataataaagttcttaacataatttactctttaaaaattacctgttcatattttgtaaacccatatttttagcacattaaaaatgaatgtttgatattacagaatattcataacaaaatggaagaattataggaattaacttgaatttggcatttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaaccccatctctactaaaaatacaaaaattagcctggcgtggtggtgtgcgcctgtaatcctagctactcgggaggctgaggcaggagcattgcttgaacctgggaggtggaggttacaatgagccaagattgtgccactgcactccagcatgggtgacagagaaagactccgtctcaaaaaaaaaaaaacaaactcttatttaatttttagttaaaattaaaacactagtacttcagaatatagatacaagtacaccatcttgaagaatttggagtttttcagggcaattcaaatgacctcattttttgttctttttgtattccagacagtgtttctgtcattggatctctgattggtagtgttaataaatattctttcagtgtgagccagattcataaaattaattttcttcattttagtagtaaaaagtagtctaatagctttttgtcagcttgatttttttgtgtgtgtaatattcaagggcagaatgacaggacagataagcaataagaaatgtatagaattagaaaatatagtagttccctcttacccatgggacatacgttccaagacccccagtgaacgtctgaaaccatggatagtatagacacctctatacactgttttttcctatacatatatacctatgataaagttctatttataaatcagggacagcaagagataaacaataactgcaaatagaacaattataacagtgcactgtaataaaagtgatgtaaatgtgatatgtctgtctctttctctcaaaatatcttattgtactgtactcacctgtaatcagactgtggttgaccgtgagtaaccgaaaccacagaaagcaaaatcgtggataaggggagactactctatatgaaacttaagttacaaaattctctgaagcatttgaaactagacgttttggaattataaaatagtccctttaaaatatccactagtagaaaaaaacttcatttgcagagaaaagattgcaataaaactcattcctaaacttttcaattttataaaattaaacattctttttttatccgtattaacaatttctagttacatagtttctagttacatattaccatatattactctttatctacaaataaatagctgatactcaaactgatcatattttgattgttaaacacttggatctctcaatacttctgtaagttaaagtgaacttaaacagtttcttgaaaaactccagtaggtggcagaatacctattgaatattcgttgctatactttgctgtttgtcattaaaacatctctacccatattcttgcaaaataatatttatattttaatggataggaaaatgatttgcaattagatgtttccattcttgaaagaaaaaagctgcaaataacattttcaagaatataaaaaaatgagtaaacaaagggaaggttgtttggtcatttatagacaattaagcacagactgtagatgtccttccaattcttgggaggctaaactgagtctaccatttcttacatttcttttacctattttttgagaattgccagttgtacagtgtttagcatgtggaatgtaccaaatatatctatgttgtgacttaagatattctaaatgtggataacttctgacctaggaaacatgaagtttgtagtgaagtaagtgaaaagaatgttcaggaaattttttttctccatctcttcagttggcatttattgagagttttatttgaatgcttattaaaagtatatgatttataatatttagaaaatagaagaaaaaagaaaactgtagatgttttatcttgttttaatactgtatgtttagtacgtatacatttatgttctagtgtatcaaaatttttcattttcattaaagtgaatccaattttccatattctaggtccattttaaaccatgaaaactttaatcacatattttgtaaagggctgaaagtatgatttaaactacagattgatatattttaattctaaatgaaaggtaatgtaaataagcatggatctgattgaataaagattttaaaatagt

SEQ ID NO: 31061 - DNA, 5613 bp, Homo sapiens
agcaggtgctggcacaagagcagcggcttgggggagccggcagcagcagtaacagcagcagcagccgccgccgccgccgccagtaaacgcggacggtaccccaggggactacccagccggccggccctggaagccgcgctcgggtcccgccgcagtcggcggtgggggatgggcaggcagtggcggtcccgcctgccgagggttaacccccgccggtcccggtcctgagctggaccagagccctcctccagaaacccctgcgtccgccacggcccaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgttgagaaagattgggggtgggggctttggagaaatttacgatgccttggacatgctcaccagggaaaatgttgcactgaaggtggaatcagctcaacaaccaaaacaagttctgaaaatggaagttgctgttttgaaaaagctgcaaggaaagaccatgtttgtagatttattggctgtgggaggaatgatcgattcaactatgtggtcatgcagttgcagggtcggaatctggcagatcttcgccgtagccagtcccgaggcacattcaccattagtaccactctccggctgggtagacagattttggagtctattgaaagcattcattctgtgggattcttgcatcgagacatcaaaccgtcgaacttcgctatgggtcgctttcctagtacatgtaggaaatgttacatgcttgattttggcttggctcgacaatttaccaattcctgtggtgacgtcagaccacctcgagctgtggcaggttttcgagggacagttcgttatgcatcaatcaacgcacatcggaacagggaaatgggaagacatgatgacctttggtccttattctacatgttggtggagtttgtggttggtcagctgccctggagaaaaataaaggacaaggagcaagtaggctctattaaggagagatatgaccacaggctcatgttgaaacatctccctccagaattcagcatctttctagaccatatctcttctttggattattttacaaaaccagactaccagatgtccatcagggtgacccggaagtcctacaaggtgtccacctctggcccccaggcctttaacagcctctcctacacgagtgggcctggtgcctgcatcagctcctcgagcttctcccgaatgggcagcagcagcttccggggtggcctgggtgcaggatatggtggggccagtggaggcatcaccaccatcactgtcaaccaaagcctgctgagccctcttaacctggaggtggaccccaacatccaggccgtgcgcacccaggaggagaagcagatcaagaccctcaacaacaagtttttctccttcatagacaaggtacggttcctggagcagcagaacaagatgcttgagaccaagtggagcctcgtgcagcagcagaagatggctcggagcaacatggacaacatgttcgagagctacatcaacaaccttaagtggcagctggagactctgggccaggagaagctgaagctggaggcggagcttggcaacatgcatgggctggtggaggacttcaggaacaagtatgaggttgagatcagtaaatgtacagagatggagaatgaatttgtgctcatcaaggagtatgtagatgaagcttacatgaacaagatggagctggagtcttccctgaaagagctgactgccaagatcagcttcctcaggcagctgtatgaagaggagatcgggagctgcagtcccagatctcggatacatctgtggtgctgttcatggacaacagccgcttcctggacatggacagcatcatccctgaggtcaaggccagagggcttccctggaggctgccacgcagataccgagcagcgtggggagctagccattaaggatgccaatgccaagctgtctgagctggaggccgccctgcagctagccagtcaagacatggcgcggcagctgcgtgagtaccaggagctgatgaacgtcaagctggccctggatatcaagatcgccacctacaggaagctgttggagggcgaggagagctggctggagtctgggatgcagaacatgagtatccatatgaagaccaccagcagctatgcaggtggtcagagcttggcctatgggggcctcacaagccctggcctcagctacggcctgggctccagctttggctctggcatgggctccagctccttcagccacaccagctcctccagggccgtggtcatgaagaagatcgaaacccgtgatgggaagctagtgtctgagtcctccaacgtcctgcccaatttgagaattactgccacacttcttacatccgtgtttgacaatagcatcaagacttttggagtaattgagagtgacccttttgactgggagaagactggaaatgatggctccctaacaaccaccactacttctaccacccctcagttgcacactcgcttgacccctgctgcaattggaattgccaatgctactcccatccctggagacttgcttcgagaaaatacagatgaggtatttccagatgaacagcttagcgatggagaaaatggcatccctgttggtgtgtcaccagataaattgcctggatctctgggacacccccgtccccaggagaaggatgtttgggaagagatggatgccaacaaaaacaagataaagcttggaatttgtaaggctgctactgaagaggagaacagccatggccaggcaaatggtcttctcaatgctccaagccttgggtcaccaattcgtgtccgctcagagattactcagccagacagagatattccactggtgcgaaagttacgttccattcacagctttgagctggaaaaacgtctgaccctggagccaaagccagacactgacaagttccttgagacctgcctggagaaaatgcagaaagataccagtgcaggaaaagaatctattctccctgctctgctgcataagccttgcgttcctgctgtgtcccgtactgaccacatctggcactatgatgaagaatatcttccagatgcctccaagcctgcttctgccaacacccctgagcaggcagatggtggtggcagcaatggatttatagctgttaacctgagctcttgcaagcaagaaattgattccaaagaatgggtgattgtggacaaggagcaggaccttcaggattttaggacaaatgaggctgtaggacataaaacaactggaagtccttctgatgaggagcctgaagtacttcaagtcctggaggcatcacctcaagatgaaaagctccagttaggtccttgggcagaaaatgatcatttaaagaaggaaacctcaggtgtggtcttagcactttctgcagagggtcctcctactgctgcttcagaacaatatacagataggctggaactccagcctggagctgctagtcagtttattgcagcgacgcccacaagtctaatggaggcgcaggcagaaggaccccttacagcgattacaattcctagaccttctgtggcatctacacagtcaacttcaggaagctttcactgtggtcagcagccagagaagaaagatcttcagcccatggagcccactgtggaactttactctccaagggaaaacttctctggcttggttgtgacagagggtgaacctcctagtggaggaagcagaacagatttggggcttcagatagatcacattggtcatgacatgttacccaacattagagaaagtaacaaatctcaagacctgggaccaaaagaacttcctgatcataatagactggttgtgagagaatttgaaaatctccctggggaaactgaagagaaaagcatccttttagagtcagataatgaagatgagaagttaagtagagggcagcattgtattgagatctcctctctcccaggagatttggtaattgtggaaaaggatcactcagctactactgaacctcttgatgtgacaaaaacacagacttttagtgtggtgccaaatcaagacaaaaataatgagataatgaagcttctgacagttggaacttcagaaatttcttccagagacattgacccacatgttgaaggtcagataggccaagtggcagaaatgcaaaaaaataagatatctaaggatgatgacatcatgagtgaagacttgccaggtcatcaaggagacctctctacttttttgcaccaagagggcaagagagagaaaatcacccctagaaatggagaactatttcattgtgtttcagagaatgaacatggtgccccaacccggaaggatatggttaggtcatcctttgtaactagacacagccgaatccctgttttagcacaagagatagactcaactttggaatcatcctctccagtttctgcaaaagaaaagctcctccaaaagaaagcctatcagccagacctagtcaagcttctggtggaaaaaagacaattcaagtccttccttggcgacctctcaagtgcctctgataaattgctagaggagaaactagctactgttcctgctcccttttgtgaggaggaagtgctcactcccttttcaagactgacagtagattctcacctgagtaggtcagctgaagatagctttctgtcacccatcatctcccagtctagaaagagcaaaattccaaggccagtttcatgggtcaacacagatcaggtcaatagctcaacttcgtctcagttctttcctcggccaccaccaggaaagccacccacgaggcctggagtagaagccaggctacgcagatataaagtcctagggagtagtaactccgactcagaccttttctcccgcctggcccaaattcttcaaaatggatctcagaaaccccggagcactactcagtgcaagagtccaggatctcctcacaatccaaaaacaccacccaagagtccagttgtccctcgcaggagtcccagtgcctctcctcgaagctcatccttgcctcgcacgtctagttcctcaccatctagggctggacggccccaccatgaccagaggagttcgtccccacatctggggagaagcaagtcacctcccagccactcaggatcttcctcctccaggaggtcctgccaacaggagcattgcaaacccagcaagaatggcctgaaaggatccggcagcctccaccaccactcagccagcactaaaaccccccaagggaagagtaagccagccagtaaactcagcagataggagccaggctgcatctctttgaaaggtgtgagatcttcctcctaaacctgatgcatgtgtgtccctgtactttctatgtaaaaaaatcagtgttgatcttctcttgcaaaagaaagtaacatgatcaattatttataagaagacataatacatgataaggaattacctaaggcaggcagcaagtagattaggaatcaatgtctttgtacaagaaggaaaaatagagcaaaaatccaagggggagaaactcattaaaatga

SEQ ID NO: 31062 - DNA, 5617 bp, Homo sapiens
agaataacgtcgggtcgggtcagcgggctctgcagtagtcgccgcagcggcgatgggagcggtggggacgaggcggcggcggcggcaggagggggagcaggtgctggcacaagagcagcggcttgggggagccggcagcagcagtaacagcagcagcagccgccgccgccgccgccagtaaacgcggacggtaccccaggggactacccagccggccggccctggaagccgcgctcgggtcccgccgcagtcggcggtgggggatgggcaggcagtggcggtcccgcctgccgagggttaacccccgccggtcccggtcctgagctggaccagagccctcctccagaaacccctgcgtccgccacggcccaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgttgagaaagattgggggtgggggctttggagaaatttacgatgccttggacatgctcaccagggaaaatgttgcactgaaggtggaatcagctcaacaaccaaaacaagttctgaaaatggaagttgctgttttgaaaaagctgcaagggaaagaccatgtttgtagatttattggctgtgggaggaatgatcgattcaactatgtggtcatgcagttgcagggtcggaatctggcagatcttcgccgtagccagtcccgaggcacattcaccattagtaccactctccggctgggtagacagattttggagtctattgaaagcattcattctgtgggattcttgcatcgagacatcaaaccgtcgaacttcgctatgggtcgctttcctagtacatgtaggaaatgttacatgcttgattttggcttggctcgacaatttaccaattcctgtggtgacgtcagaccacctcgagctgtggcaggttttcgagggacagttcgttatgcatcaatcaacgcacatcggaacagggaaatgggaagacatgatgacctttggtccttattctacatgttggtggagtttgtggttggtcagctgccctggagaaaaataaaggacaaggagcaagtaggctctattaaggagagatatgaccacaggctcatgttgaaacatctccctccagaattcagcatctttctagaccatatctcttctttggattattttacaaaaccagactaccagcttcttacatccgtgtttgacaatagcatcaagacttttggagtaattgagagtgacccttttgactgggagaagactggaaatgatggctccctaacaaccaccactacttctaccacccctcagttgcacactcgcttgacccctgctgcaattggaattgccaatgctactcccatccctggagacttgcttcgagaaaatacagatgaggtatttccagatgaacagcttagcgatggagaaaatggcatccctgttggtgtgtcaccagataaattgcctggatctctgggacacccccgtccccaggagaaggatgtttgggaagagatggatgccaacaaaaacaagataaagcttggaatttgtaaggctgctactgaagaggagaacagccatggccaggcaaatggtcttctcaatgctccaagccttgggtcaccaattcgtgtccgctcagagattactcagccagacagagatattccactggtgcgaaagttacgttccattcacagctttgagctggaaaaacgtctgaccctggagccaaagccagacactgacaagttccttgagacctgcctggagaaaatgcagaaagataccagtgcaggaaaagaatctattctccctgctctgctgcataagccttgcgttcctgctgtgtcccgtactgaccacatctggcactatgatgaagaatatcttccagatgcctccaagcctgcttctgccaacacccctgagcaggcagatggtggtggcagcaatggatttatagctgttaacctgagctcttgcaagcaagaaattgattccaaagaatgggtgattgtggacaaggagcaggaccttcaggattttaggacaaatgaggctgtaggacataaaacaactggaagtccttctgatgaggagcctgaagtacttcaagtcctggaggcatcacctcaagatgaaaagctccagttaggtccttgggcagaaaatgatcatttaaagaaggaaacctcaggtgtggtcttagcactttctgcagagggtcctcctactgctgcttcagaacaatatacagataggctggaactccagcctggagctgctagtcagtttattgcagcgacgcccacaagtctaatggaggcgcaggcagaaggaccccttacagcgattacaattcctagaccttctgtggcatctacacagtcaacttcaggaagctttcactgtggtcagcagccagagaagaaagatcttcagcccatggagcccactgtggaactttactctccaagggaaaacttctctggcttggttgtgacagagggtgaacctcctagtggaggaagcagaacagatttggggcttcagatagatcacattggtcatgacatgttacccaacattagagaaagtaacaaatctcaagacctgggaccaaaagaacttcctgatcataatagactggttgtgagagaatttgaaaatctccctggggaaactgaagagaaaagcatccttttagagtcagataatgaagatgagaagttaagtagagggcagcattgtattgagatctcctctctcccaggagatttggtaattgtggaaaaggatcactcagctactactgaacctcttgatgtgacaaaaacacagacttttagtgtggtgccaaatcaagacaaaaataatgagataatgaagcttctgacagttggaacttcagaaatttcttccagagacattgacccacatgttgaaggtcagataggccaagtggcagaaatgcaaaaaaataagatatctaaggatgatgacatcatgagtgaagacttgccaggtcatcaaggagacctctctacttttttgcaccaagagggcaagagagagaaaatcacccctagaaatggagaactatttcattgtgtttcagagaatgaacatggtgccccaacccggaaggatatggttaggtcatcctttgtaactagacacagccgaatccctgttttagcacaagagatagactcaactttggaatcatcctctccagtttctgcaaaagaaaagctcctccaaaagaaagcctatcagccagacctagtcaagcttctggtggaaaaaagacaattcaagtccttccttggcgacctctcaagtgcctctgataaattgctagaggagaaactagctactgttcctgctcccttttgtgaggaggaagtgctcactcccttttcaagactgacagtagattctcacctgagtaggtcagctgaagatagctttctgtcacccatcatctcccagtctagaaagagcaaaattccaaggccagtttcatgggtcaacacagatcaggtcaatagctcaacttcgtctcagttctttcctcggccaccaccaggaaagccacccacgaggcctggagtagaagccaggctacgcagatataaagtcctagggagtagtaactccgactcagaccttttctcccgcctggcccaaattcttcaaaatggatctcagaaaccccggagcactactcagtgcaagagtccaggatctcctcacaatccaaaaacaccacccaagagtccagttgtccctcgcaggagtcccagtgcctctcctcgaagctcatccttgcctcgcacgtctagttcctcaccatctagggctggacggccccaccatgaccagaggagttcgtccccacatctggggagaagcaagtcacctcccagccactcaggatcttcctcctccaggaggtcctgccaacaggagcattgcaaacccagcaagaatggcctgaaaggatccggcagcctccaccaccactcagccagcactaaaaccccccaagggaagagtaagccagccagtaaactcagcagataggagccaggctgcatctctttgaaaggtgtgagatcttcctcctaaacctgatgcatgtgtgtccctgtactttctatgtaaaaaaatcagtgttgatcttctcttgcaaaagaaagtaacatgatcaattatttataagaagacataatacatgataaggaattacctaaggcaggcagcaagtagattaggaatcaatgtctttgtacaagaaggaaaaatagagcaaaaatccaagggggagaaactcattaaaatgagctctcattttttaagctgcctttgaaacaaaagagttgaggataggagatagaatggaattttaggggggttgcctaatttttttaagcctcaattcaaagattatatagcaaaagtgaaacttcttgtttgatattttcattcaaaactttcccaccctgaagagtcattgatcagatattagattatataagaagtctgttgccagggagccagtattcatgtatatttggcttgtgtgtttatttcgtgtattgagaatgaacacctttactttgcctcattcctagtaccctccctggagttcagatttttttttaaaattttgtatgtctcgtctgattcaatctctctgcttttattttatggtcctagttgtactatcaaatccaattacttttttttaggtccccctgattttttttttttagagcaagagttcttaacatattacatttttattatgaaaaataagaaagttaggtaaaggaaagaaaagtctaactagagctattttgcaggctttagtgtttagggagagaaagaaagtgtgggttaatagccttcaagatagaagatgccctttcatctctgttaagtgtcctcctttagaaacttgagtagaaggaaaactgaccagagtagactgcttccttaagtcttctgggttccaactgtttgtaatatcagcatccaagatgatacgagggaagcacaatgctttggactgtgatttgagatttagaaataaattagatatattattgaggcttagaatcctcaaactttgtattttatacatttagccaataaggaattaatatctggggaaataaatttaggcaaatatttcttttttaatgttttattacctgcttctcctgtgttttagttcaacatttgggcttcttggcctgattttcatacaatctcaatttacgaagctgtaaagaggaagatatttgttctaatctcactcttctaataggaatcaggcaaatgaaagtctaccagacttttaaaatgggctgtttttatactctctaggtgttttgtgttgtaaagaccttattaaggtcaggtaaattggtctgcttgctgttgaaatttgccttctagcaaacatatgtgctttctgtttgaccttgtgtttgctgccaaacctaatacagttgaattggg

SEQ ID NO: 31063 - DNA, 4968 bp, Homo sapiens
gagccagggaaagaccatgtttgtagatttattggctgtgggaggaatgatcgattcaactatgtggtcatgcagttgcagggtcggaatctggcagatcttcgccgtagccagtcccgaggcacattcaccattagtaccactctccggctgggtagacagattttggagtctattgaaagcattcattctgtgggattcttgcatcgagacatcaaaccgtcgaacttcgctatgggtcgctttcctagtacatgtaggaaatgttacatgcttgattttggcttggctcgacaatttaccaattcctgtggtgacgtcagaccacctcgagctgtggcaggttttcgagggacagttcgttatgcatcaatcaacgcacatcggaacagggaaatgggaagacatgatgacctttggtccttattctacatgttggtggagtttgtggttggtcagctgccctggagaaaaataaaggacaaggagcaagtaggctctattaaggagagatatgaccacaggctcatgttgaaacatctccctccagaattcagcatctttctagaccatatctcttctttggattattttacaaaaccagactaccagcttcttacatccgtgtttgacaatagcatcaagacttttggagtaattgagagtgacccttttgactgggagaagactggaaatgatggctccctaacaaccaccactacttctaccacccctcagttgcacactcgcttgacccctgctgcaattggaattgccaatgctactcccatccctggagacttgcttcgagaaaatacagatgaggtatttccagatgaacagcttagcgatggagaaaatggcatccctgttggtgtgtcaccagataaattgcctggatctctgggacacccccgtccccaggagaaggatgtttgggaagagatggatgccaacaaaaacaagataaagcttggaatttgtaaggctgctactgaagaggagaacagccatggccaggcaaatggtcttctcaatgctccaagccttgggtcaccaattcgtgtccgctcagagattactcagccagacagagatattccactggtgcgaaagttacgttccattcacagctttgagctggaaaaacgtctgaccctggagccaaagccagacactgacaagttccttgagacctgcctggagaaaatgcagaaagataccagtgcaggaaaagaatctattctccctgctctgctgcataagccttgcgttcctgctgtgtcccgtactgaccacatctggcactatgatgaagaatatcttccagatgcctccaagcctgcttctgccaacacccctgagcaggcagatggtggtggcagcaatggatttatagctgttaacctgagctcttgcaagcaagaaattgattccaaagaatgggtgattgtggacaaggagcaggaccttcaggattttaggacaaatgaggctgtaggacataaaacaactggaagtccttctgatgaggagcctgaagtacttcaagtcctggaggcatcacctcaagatgaaaagctccagttaggtccttgggcagaaaatgatcatttaaagaaggaaacctcaggtgtggtcttagcactttctgcagagggtcctcctactgctgcttcagaacaatatacagataggctggaactccagcctggagctgctagtcagtttattgcagcgacgcccacaagtctaatggaggcgcaggcagaaggaccccttacagcgattacaattcctagaccttctgtggcatctacacagtcaacttcaggaagctttcactgtggtcagcagccagagaagaaagatcttcagcccatggagcccactgtggaactttactctccaagggaaaacttctctggcttggttgtgacagagggtgaacctcctagtggaggaagcagaacagatttggggcttcagatagatcacattggtcatgacatgttacccaacattagagaaagtaacaaatctcaagacctgggaccaaaagaacttcctgatcataatagactggttgtgagagaatttgaaaatctccctggggaaactgaagagaaaagcatccttttagagtcagataatgaagatgagaagttaagtagagggcagcattgtattgagatctcctctctcccaggagatttggtaattgtggaaaaggatcactcagctactactgaacctcttgatgtgacaaaaacacagacttttagtgtggtgccaaatcaagacaaaaataatgagataatgaagcttctgacagttggaacttcagaaatttcttccagagacattgacccacatgttgaaggtcagataggccaagtggcagaaatgcaaaaaaataagatatctaaggatgatgacatcatgagtgaagacttgccaggtcatcaaggagacctctctacttttttgcaccaagagggcaagagagagaaaatcacccctagaaatggagaactatttcattgtgtttcagagaatgaacatggtgccccaacccggaaggatatggttaggtcatcctttgtaactagacacagccgaatccctgttttagcacaagagatagactcaactttggaatcatcctctccagtttctgcaaaagaaaagctcctccaaaagaaagcctatcagccagacctagtcaagcttctggtggaaaaaagacaattcaagtccttccttggcgacctctcaagtgcctctgataaattgctagaggagaaactagctactgttcctgctcccttttgtgaggaggaagtgctcactcccttttcaagactgacagtagattctcacctgagtaggtcagctgaagatagctttctgtcacccatcatctcccagtctagaaagagcaaaattccaaggccagtttcatgggtcaacacagatcaggtcaatagctcaacttcgtctcagttctttcctcggccaccaccaggaaagccacccacgaggcctggagtagaagccaggctacgcagatataaagtcctagggagtagtaactccgactcagaccttttctcccgcctggcccaaattcttcaaaatggatctcagaaaccccggagcactactcagtgcaagagtccaggatctcctcacaatccaaaaacaccacccaagagtccagttgtccctcgcaggagtcccagtgcctctcctcgaagctcatccttgcctcgcacgtctagttcctcaccatctagggctggacggccccaccatgaccagaggagttcgtccccacatctggggagaagcaagtcacctcccagccactcaggatcttcctcctccaggaggtcctgccaacaggagcattgcaaacccagcaagaatggcctgaaaggatccggcagcctccaccaccactcagccagcactaaaaccccccaagggaagagtaagccagccagtaaactcagcagataggagccaggctgcatctctttgaaaggtgtgagatcttcctcctaaacctgatgcatgtgtgtccctgtactttctatgtaaaaaaatcagtgttgatcttctcttgcaaaagaaagtaacatgatcaattatttataagaagacataatacatgataaggaattacctaaggcaggcagcaagtagattaggaatcaatgtctttgtacaagaaggaaaaatagagcaaaaatccaagggggagaaactcattaaaatgagctctcattttttaagctgcctttgaaacaaaagagttgaggataggagatagaatggaattttaggggggttgcctaatttttttaagcctcaattcaaagattatatagcaaaagtgaaacttcttgtttgatattttcattcaaaactttcccaccctgaagagtcattgatcagatattagattatataagaagtctgttgccagggagccagtattcatgtatatttggcttgtgtgtttatttcgtgtattgagaatgaacacctttactttgcctcattcctagtaccctccctggagttcagatttttttttaaaattttgtatgtctcgtctgattcaatctctctgcttttattttatggtcctagttgtactatcaaatccaattacttttttttaggtccccctgattttttttttttagagcaagagttcttaacatattacatttttattatgaaaaataagaaagttaggtaaaggaaagaaaagtctaactagagctattttgcaggctttagtgtttagggagagaaagaaagtgtgggttaatagccttcaagatagaagatgccctttcatctctgttaagtgtcctcctttagaaacttgagtagaaggaaaactgaccagagtagactgcttccttaagtcttctgggttccaactgtttgtaatatcagcatccaagatgatacgagggaagcacaatgctttggactgtgatttgagatttagaaataaattagatatattattgaggcttagaatcctcaaactttgtattttatacatttagccaataaggaattaatatctggggaaataaatttaggcaaatatttcttttttaatgttttattacctgcttctcctgtgttttagttcaacatttgggcttcttggcctgattttcatacaatctcaatttacgaagctgtaaagaggaagatatttgttctaatctcactcttctaataggaatcaggcaaatgaaagtctaccagacttttaaaatgggctgtttttatactctctaggtgttttgtgttgtaaagaccttattaaggtcaggtaaattggtctgcttgctgttgaaatttgccttctagcaaacatatgtgctttctgtttgaccttgtgtttgctgccaaacctaatacagttgaattggg

SEQ ID NO: 31064 - DNA, 2478 bp, Homo sapiens
ggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaa

SEQ ID NO: 31065 - DNA, 2890 bp, Homo sapiens
gaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaaggtcagaattcccagagtcctcaatgtttcaaaacatgctcagagcaaaatggttatgttctcacattgtcaaatgcacaaccagttctgcaatatggtaatccttatgcatctcaggaaacaagagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataaca

SEQ ID NO: 31066 - DNA, 641 bp, Homo sapiens
acatatcctttctggtgctattgcaaggtttgtcagggttttacggcaacagaagactatgatgaattcgaatgggacacatttgcttctgtggagttacgattcaaactgaatgtccaatataggaaggcaacatatacaacaagcaaaagtgattttagaaataacagaacgcgggagaaaattcacacacggaaaatgatacggataacaaaagcagattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattct

SEQ ID NO: 31067 - DNA, 570 bp, Homo sapiens
aatagaatcagagggcattagaactgaaaagctcctaggagctttcagtgaacaaaacttcatagccaaaaaagcacacgactgggccaggagttcagagacagtcttggtgctcaggggtttgcagccctagccgtgtggtcactcccttgcttctctggctatttccttatctataaaatgagtgggctagtttaggccgactgagacgcagacagggatacggtactgtccatggacctctgagctgccctttccacatcgctgattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaatt

SEQ ID NO: 31068 - DNA, 2221 bp, Homo sapiens
aggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagt

SEQ ID NO: 31069 - DNA, 2693 bp, Homo sapiens
acggcaacagaagactatgatgaattcgaatgggacacatttgcttctgtggagttacgattcaaactgaatgtccaatataggaaggcaacatatacaacaagcaaaagtgattttagaaataacagaacgcgggagaaaattcacacacggaaaatgatacggataacaaaagcagattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgca

SEQ ID NO: 31070 - DNA, 4119 bp, Homo sapiens
ctcttcggctgctgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaatgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagcatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgtttt

SEQ ID NO: 31071 - DNA, 5700 bp, Homo sapiens
ctcttcggctgctgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggttcctttttgagtgtcactgtgtttgtaaagagcattcacaatacggtggaatttcaaaagctggaagagctcgagatcatgcctcaggcaaaggcgtgggtccatcgttcttccgagagggtttgtgtggcgactacaccctcagcgtccctggcaaggtgcagttggctctcgcccattcttgttatggaaacctaagatgatcattgggaagatcagtgatcttgggtcattgatccctggctcagaggatagcggtttccatcataaaccaagatgatgagttcagcctttatccctcgtggttccactagatgtaacttaaaggagttaacatttgaggactttgttctacatcagattttactatttgaatgtttaagatcactttattgaatttgaagatcatcaaattaaataaaatgatttatttaatttggatatcctgatcactgtcaagtgaaatggatctctctctttggtatttaaggaagtttgtctttaaaaaaaaaatagagtgttttcatacatttttgcttatcccataagtacagttgatcaaagtcatagtaggtaaatgctttatgggacagctgacaccttttagaccctaccaggtattgctagcatgtgagctgcagttgtggggtctgagatatttctttgtggtagtttcatacccatactatagagtcatgtatttatttttgcctgttgtgtgatgtaatgcaatcatgttcctttgagtctccatcccttggaaatctgacttcttgcagaaggagtaggcacatcaagatattcaggggtgccccaagagtctgggactttcaaaaaaaaaagatcaggctgaaactgcagtcagatttatgacagctgacagtttttcagaggtcgcacacagtgactctcctctctcaggatgacgaggacctgtgccttcaacaagcaaaatgctgctcacggttgtcctgcttgcagccagtcactgtgtaaagcctctctgatgtgcacttaagagtgggttgctttctcacaaagatggggttctgtgcagtcacaggtcacttccttgacaacacaatcatttctgatctttatcactgtaaccacgtcttctattccataggagtttcttttgattctctcagttgcggggggcatctcttaatcctggggtaaaaggagagattgccatacttagactcactgtgagtctccccggccatttcacgaggagaccacagtgctgccaccagtgcctaaacaggtggctggcattcgagacttcctcctgttccctgggtcagaggatagcggtttccatcataaaccaagatgatgagttcagcctttatccctcgtggttccgctagatgtaacttataggagttaacatttgaggactttgttctgcatcagatcttactatttgaatgtttactgttggattttgggcatcttattactgttactcaaaaacattgactctgcatcaagaaagaaacaagaaagcaataaaacaagaaataattcatgctcaca

SEQ ID NO: 31072 - DNA, 2383 bp, Homo sapiens
cccaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggttcctttttgagtgtcactgtgtttgtaaagagcattcacaatacggtggaatttcaaaagctggaagagctcgagatcatgcctcaggcaaaggcgtgggtccatcgttcttccg

SEQ ID NO: 31073 - DNA, 1520 bp, Homo sapiens
ggaggaggaggaagtgagaggaggaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacggcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccggcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaacaga

SEQ ID NO: 31074 - DNA, 6578 bp, Homo sapiens
gctgaggagaaagcggcgcgcggagggtgtgagatggcagacaggtttgcaggaaaccctcagaaagggggctggaggatttagccactctgtcctccccttccggcagtccagggcctcctcccgagcacagcggcgctatggactctccaggatacaactgcttcgtggacaaagacaagatggacgctgccatccaggacctggggcccaaggagctgagctgcactgaactgcaggaactgaagcagctggcgcgccagggctactgggcccaaagccacgccctgcggggaaaggtgtaccagcgcctgatccgggacattccctgccgcacggtcacgcctgacgccagcgtgtacagcgacatcgtgggcaagatcgtgggcaagcacagcagcagctgcctgccgctgcccgagttcgtggacaacacgcaggtgcccagctactgcctgaatgcacgcggcgagggggccgtgcgcaagatcctcctgtgcctggccaaccagttccccgacatctccttctgccccgccctgccggccgtggtggccctgctgctgcactacagcatcgacgaggccgagtgcttcgagaaggcctgccgcatcctggcctgcaatgaccccggcaggaggctgatcgaccagagcttcctggcctttgagtcgtcctgcatgacgtttggggacctggtgaacaagtactgccaggcggcccacaagctgatggtggccgtgtcggaggatgtcctgcaggtctatgcggactggcagcgctggctgtttggggagctgcccctctgctacttcgcccgggtctttgacgtcttcctggtggagggctacaaggtgctgtaccgcgtggcgctggccatcctcaagttcttccacaaggtgagggccgggcagccgctggagtcggacagcgtgaagcaggacatccgcacgttcgtcagagacatcgcgaagacggtgtcccctgagaagctgctggagaaagcgttcgccatccgcctcttctcccgcaaggagatccagctcctgcagatggccaatgagaaagccctgaagcagaagggcatcaccgtgaagcagaagaggcagtttgtacacttggccgtccatgcagagaacttccgctcggagatcgtcagcgtgagggagatgagagacatctggtcctgggtccccgagcgctttgccctgtgccagccccttctgctgttctcctccctgcagcacgggtacagcctggccaggttctacttccagtgtgaaggacatgagcctaccctcttgctcatcaagaccacgcagaaggaggtgtgtggtgcttacctgtccacagactggagtgagagaaataagtttggaggcaaactgggcttctttgggaccggagaatgctttgtgtttaggctgcagcctgaggtgcagcgctacgagtgggtggtgatcaagcaccccgagctgaccaagcccccacccttgatggctgccgagcccaccgccccactcagccactccgcctcctcagaccccgctgaccgcctctcgcccttcctggccgctcgccacttcaacctgccctccaagaccgagtccatgttcatggcggggggcagcgactgcctcatcgtcgggggaggaggcggccaggcgctctacatcgatggggacctgaaccggggccgcacaagccactgcgacaccttcaacaaccagcccctctgctccgagaacttcctcattgctgccgtggaggcctggggcttccaggaccctgacacccagtgacggcctgtgccacggtgactgagccgtggtggggcggtgggccgaggctgggctgccgcctcgggcagcagagagcagatgaaacccccatgtggtaggcagggttgggggacggcaggaccccatggccaagcctggcgttgcctggacctgctgctgcctctacctggggtttgggctgggcttccccagtccacctgcatctgggtcagagctggagggcctgctgtgcccccagccccacccagagctggcataggaagtaccttcctcctccgtggaggcttccatagcccaaggccttgggagtgtctgggtcttgctgcccctgagcctctctaggcagcctgagcccctggggtgggagtacaacggcagtgggaacgtgcagctaagggtgggcctgtggtgccccctgctggtgccgcatagcatcgcgccctcctgagcagggccctgcagcctggctggctggcgactgaatcccagcgtagatcccgagaacagactggcacccttgggcctgccccctggcggaccccaccccctgtcctgggcgtttgccccagttccctccccaggcctcctgggccacctctcacattaacccttcttggctgcctctgaggctcccctgggctgcgtttgggagctgctgggtgggaggaggagggtgggatttgtgctgggctccacccccagggagggtgggagctggagggggatgtcacatgtccttgtgtttctgcagagcctgaagcttttgctgggcctccctgcgtgttcccatctgaagaggtagccccgggagaggccctcagggaccgacccagaccagcaagctccatttccaggggtctgcccagagaagcctggacccagggggcttctcagctcccctcccttccagcccaggcctccttgagctcctgtagcctctgcagctgcccatttcacctctttgtcattgcaatgacctggggcccagggtcacgcccaagcccctctttgtggcatgctcatctcagtgcagccccaactgcttctctgcaccaggccccgtgccctcccctggccctggccacacagcacctccttggccaccttgcatggatgcatgtcctccctctgtccctcttgtggtgctgtggctggccacgtgtcagggttttctgtgagcctctcaccttacagcctttgggcccctgggcccctgccctgcctgagccctgcgctggccagacgcaggtaggtgccaggggaggccttgcctctgggcactatagggggcagccccctgccttgtgacctccctccatgccccatgacctccttcaactcgtcttgagggtctggtcaccacggaggggagaagggagacacagaggcccaagtggctgttctgggaccatggaagcctgggtcacagaggcaggtaccagcagtcctgcccccacccccgtccctgctggcctccagccagtgccacttggagtcccctgcaccgtgccactttccatccccacaccattgcctgctcctcccatggggctttagcctcccctgaccatctgctcatgtagcctctgactgggcgcacagtggtgcaggaggaaggaccgggaaccctgtgtggctttgggcaagctgacaaacccgtctggaactcagtttccccagctgtgaaatggggccagtccccatgccctgctgtcctcctcacaggactgttgagaggctcgcagggggatggggtgaatccctctcacggggagaggtatgggagggaagtcgccactcatctcagcccaccgcagccctccaggcccccgcctgagcccctgaggccctcatctgtaccgccagctttggtgttcattaaacatggtcttgctgcatcaactccagggctccaagctgagtctgatctcttcagccagaggggcctccgggggcttcctgggcctacagccaagcaggtgtgggaggctgcccgctgtagtgctcacccacattctatgactggaatgctgcaagcctcttccagagggagccctccaggagcagggaagtcatatccgtggaccatttgtaggtttccctctgcaaacttcctgaactgggtggtgatttttctggcgagttaagtccagcaggttctgcgtggctgcccccagggggccccacccgggccttccagtgatctggaccaggaagacggattgctgctgggtcatgatttccacatcatgagcgaagttctttgttttttgtgtgcatgcaaaatattgtttctttaaatttaatatcttttcctaacttttctactaacctagaaggtatgtgtgattattatcttttttattcttatcactgtacttgttagtatctgatattaggtattcccaaatagaacataatttattttgttaatgttctctatttcttcttgattatttattagctttggatgttaaaaattagccaaaagtggctgctctgcctatgaagtagccattctttgtttaaaaaaaaaaaaagccaacatttgttgaaactgcataataaattatcatttgtttttagaaacattcaaagaattattttttgattttttttttttttgggacagagtcacccaggctggagtgcagtggcatgatcttggctcactgcaacctccgcctcctgggttcaagcgattctcctgcctcagcctcctgagtagctgggattacaggcatacgccaccacgcccagctaaattttttttgtatttttagtagaggcagggtttcactgtgttggtcaggctggtcttgaactcctgacctcgtgatccacccccccctcagcctcccaaagtgctgggattacaggcgtgagccaccgcgcctagcctattttttaatttttttgaatagaccactttgtgctgaataaatgtttaacatttatttttaaaacaacaattgcacctaatttaaaatagtttattaaatgaattcattaaagcagattatatgcctttggggcttcagaaaatcagtttaagcaaaagaacttatgagagtaagtcatttgtacttgaattttttcagagttttaatgaactaaagtattttaatttttctatttttgtaagccgcatacttcattttttgagtttttcagtggaatttgttttaaaacgttttgaagatttcagaggccttcatatttctcttatccactttctgaacccataaagcctttgcagtctccttgagtagtttatatttagtaatttagttgtgtacctttttattttgaagtaatttttgatttgcagaagagttgcagagacggtacagggtttccatgtaccctcaccttcccccaagtcaatatcaaaacaaagaaataagcattgttgcattgctgttaactaaaccacaggcctattgagattgtcccttttttttttttttttttttttgagacagagtctcgctctgtcgcccaggctggagtgcagtggcgcgatctcggctcaccgcaagccccgcctcccggattcacgccattctcctgcctcagcctcctgagtagctgggactacaggcacctgctaccacacccggctaatttttttatatttttagtagagatggggtttcaccgtgttagccaggatggtcttgatctcctgacctcgtgatctgccctcctcggcctcccaaagtgctgggattacaggcgtgagcaaccgcgcccagccgagattgccccgtttttttcccactgtccaggaatcgatttaatttttacagttgtttactttctcacatttttactaagtccagaatatcatcaaactcacaaaaccactggtcaaaaaaacccaaatggccactaattaggcaatacagcacctgcctcaaatttgggttcatatagatttttttcctccctttttgtggagaacatagtcttgctgtgttgcccaggctagtcttgaactcctggactcaagcaatcctcccgcctctgcctccctaaattctgggattacaggcgtgagctgctgtgcccagctcatccagattcttgctggttctctttctcagcctaaatgtcttgtttgcgtggagaaattatcaaatgaagcaggagtgccaaacaagcctcataggctcttcaccctacaacatctatgttaggtagaaaagtatgtggatttttaaaaatcatctggtataaagagtttttaagaactatcttcatcatcttagtatcagattgtgcttgagaagttaggtacaatgtaatgtgattcattgctaaaaacaaaatgcctcccacaattgcagactcactcattttaccaaactatggaatttgtcaacaccttttcttgggaccaaggaagcaaagtcagtggataccgtgtcctgtagacatgtcacttgtgataaggcacggacaacatgaactggcaaaaacattggcatttggtcaaatgcttatgagctaaggatagaagggaaaaaatagttgtgtgaatgattttacctcttagttcttacgaaggatggttatcgggctggaaaaatgtttattggactgatgctttggagcctctcaatgaatgtaataaaaaaaatgtgtagtgagcacaaatgtatggatttgcagcacaatccaactttgaaaatgtgaaaataagtgagttagtgatatgtttggttggtgttaatttgagtcctaaataaaatcgagaactggtaaaagaag

SEQ ID NO: 31075 - DNA, 2077 bp, Homo sapiens
ggggtccgcggcgcccattgggcgtggggggagagctccggggtgggcctggagccccgccccccggccttgcggcggccaataggcgccgcgcgtgggcggggcgtcggcggcagcagggcggctgaggtggccgctggagctcaggcggcgggcgcggctgggatggcgaagagcaacggagagaatgggccgcgcgcgcccgcggccggggaaagcctgtcgggaacccgggagagcctggcccagggccccgacgccgcaaccaccgacgaactcagctctctcgggtctgactcggaggccaacggcttcgccgagcgccgcatcgacaagttcggcttcatcgtgggctcgcagggcgccgagggcgcgctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccggggtgagctgcagtgccgctccccgcccaggctgcatggtgccaaggctatcttggatgcagaacctggtccccggcctgccctacaaccttcaccatccatccgcctgcccctagatgcccccctccctggctccaaagccaagcccaagccacccaagcaggcccagaaggagcagcggaaacagatgaaggggagagggcagctggagaagcccccagccccaaatcaagccatggtggtggccgctgcaggagatgcatgtcccccacagcatgtgcccccgaaggactcagcccccaaggactcagcccctcaggatttggctccccaggtctcagcccaccaccgctcccaggagagcttgacgtcccaagagagtgaggacacctacttgtaaccctggcagctaaggcctccagggcggggtctccatataactacacggttcatgaactgacattccacatcctgcccaccctctgagggccaagctgcctggccactgggctgggctggagtctggctggtccaacacagattctgcctggtccaacacagattctgcctgagcctccttatttattttctttacagtggcactcaggctggcccagccagggcaggcagaagctagggcctggggggtggggcctccttcagccccctcctcctgggggatgctccccagggttagggtgctggtgtgaggggaaagggtggggtgttctttgtgtaaaatagaaacatggttttgtacagaaataaacagccttgtatagaga

SEQ ID NO: 31076 - DNA, 1833 bp, Homo sapiens
cccggaaggcggacgttgcagtgagccgagatcgcgccattgcactccagcctgggcaacaagcgcaaaactccgtctcaaaaaaataaaataaaaaggggagaatgatgttatagtagggttattacaaaaggtacatgtgataaaggctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccggggtgagctgcagtgccgctccccgcccaggctgcatggtgccaaggctatcttggatgcagaacctggtccccggcctgccctacaaccttcaccatccatccgcctgcccctagatgcccccctccctggctccaaagccaagcccaagccacccaagcaggcccagaaggagcagcggaaacagatgaaggggagagggcagctggagaagcccccagccccaaatcaagccatggtggtggccgctgcaggagatgcatgtcccccacagcatgtgcccccgaaggactcagcccccaaggactcagcccctcaggatttggctccccaggtctcagcccaccaccgctcccaggagagcttgacgtcccaagagagtgaggacacctacttgtaaccctggcagctaaggcctccagggcggggtctccatataactacacggttcatgaactgacattccacatcctgcccaccctctgagggccaagctgcctggccactgggctgggctggagtctggctggtccaacacagattctgcctggtccaacacagattctgcctgagcctccttatttattttctttacagtggcactcaggctggcccagccagggcaggcagaagctagggcctggggggtggggcctccttcagccccctcctcctgggggatgctccccagggttagggtgctggtgtgaggggaaagggtggggtgttctttgtgtaaaatagaaacatggttttgtacagaaata

SEQ ID NO: 31077 - DNA, 1950 bp, Homo sapiens
aggcggcgggcgcggctgggatggcgaagagcaacggagagaatgggccgcgcgcgcccgcggccggggaaagcctgtcgggaacccgggagagcctggcccagggccccgacgccgcaaccaccgacgaactcagctctctcgggtctgactcggaggccaacggcttcgccgagcgccgcatcgacaagttcggcttcatcgtgggctcgcagggcgccgagggcgcgccctgccctctgctccacaggctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccggggtgagctgcagtgccgctccccgcccaggctgcatggtgccaaggctatcttggatgcagaacctggtccccggcctgccctacaaccttcaccatccatccgcctgcccctagatgcccccctccctggctccaaagccaagcccaagccacccaagcaggcccagaaggagcagcggaaacagatgaaggggagagggcagctggagaagcccccagccccaaatcaagccatggtggtggccgctgcaggagatgcatgtcccccacagcatgtgcccccgaaggactcagcccccaaggactcagcccctcaggatttggctccccaggtctcagcccaccaccgctcccaggagagcttgacgtcccaagagagtgaggacacctacttgtaaccctggcagctaaggcctccagggcggggtctccatataactacacggttcatgaactgacattccacatcctgcccaccctctgagggccaagctgcctggccactgggctgggctggagtctggctggtccaacacagattctgcctggtccaacacagattctgcctgagcctccttatttattttctttacagtggcactcaggctggcccagccagggcaggcagaagctagggcctggggggtggggcctccttcagccccctcctcctgggggatgctccccagggttagggtgctggtgtgaggggaaagggtggggtgttctttgtgtaaaatagaaacatggttttgtacagaaataaacagccttgtatag

SEQ ID NO: 31078 - DNA, 3350 bp, Homo sapiens
ggctggcctcgccgggaggcccgaggggcggcgccttctgcggcctccccggcggggggatgtgaggggcggcccgcggccatggagacgggcacggcgcccctggtggccccgccgcgccgtcatggcgcccccgcggccccctcgccgccgccccggggttcccgggccgggcccgtcgtggtggtggctccgggacctccagtgactacggccacttcggcccccgtcaccctggtggcccccggggaggcgcggcccgcctgggtcccggggtcggccgagacctctgctccggccccggccccagccccggccccagccccggctgtcacgggcagcacggtggtggtgctgaccctggaggcctcgcccgaagccccaaagccgcagctcccctccggcccggaatccccagagcccgcggcagtggctggagttgagacatcgagggctctggccgcaggggcagactcgccgaagacagaggaggctcgaccctcacccgccccaggaccagggacccccaccgggacccctaccaggaccccttccagaacggctcctggtgccctgaccgccaaacccccgcttgcccccaagccgggaaccacagtggcctcaggagtgactgcacggagtgcatcaggacaagtgacaggtgggcatggagctgccgcagcaacatcagcatcagcaggacaggctcctgaggacccctcaggccctggcacaggcccctctgggacttgtgaggctccggtagctgtcgtgaccgtgaccccagctccggagcctgctgaaaactctcaagacctgggctccacgtccagcctgggacctggcatctctgggcctcgagggcaggccccggacacgctgagttacttggactccgtgagcctcatgtctgggaccttggagtccttggcggatgatgtgagctccatgggctcagattcagagataaacgggctggccctgcgcaagacggacaagtatggcttccttgggggcagccagtactcgggcagcctagagagctccattcccgtggacgtggctcggcagcgggagctcaaatggctggacatgttcagtaactgggataagtggctgtcacggcgattccagaaggtgaagctgcgctgccggaaggggatcccctcctctctcagagccaaagcctggcagtacctgtctaatagcaaggaacttctggagcagaacccaggaaagtttgaggagctggaacgggctcctggggaccccaagtggctggatgtgattgagaaggacctgcaccgccagttccctttccacgagatgtttgctgctcgaggggggcatgggcaacaggacctgtaccgaatcctgaaggcctacaccatctaccggcctgacgagggttactgccaggcccaggcccccgtggctgcggtcctgctcatgcacatgcctgcggagcaagccttttggtgcctggtgcagatctgcgacaagtacctcccaggttactacagtgcagggctggaggccattcagctggacggggagatcttttttgcactcctgcgccgggcctccccgctggcgcatcgccacctgcggcggcagcgcattgaccctgtgctctacatgacggagtggttcatgtgcatcttcgcccgcaccctgccctgggcgtcggtgctgcgtgtctgggacatgtttttctgtgaaggcgttaagatcatcttccgggtggccctggtcctgctgcgccacacgctgggctcagtggagaagctgcgctcctgccaaggcatgtatgagaccatggagcagctgcgtaacctgccccagcagtgcatgcaggaagacttcctggtgcatgaggtgaccaatctgccggtgacagaagcactgattgagcgggagaatgcagcccagctcaagaagtggcgggaaacgcggggggagctgcagtatcggccctcacggcgactgcatgggtcccgggccatccacgaggagcgccggcggcaacagccacccctgggcccctcctccagcctcctcagcctccctggcctcaagagccgaggctcccgggcagctggaggggccccgtccccgccgccccccgtccgcagagccagtgctgggcctgccccagggcctgtggtcactgctgagggactgcatccatcccttccctcacccactggcaatagcacccccttgggttccagcaaggagacccggaagcaggagaaggagcggcagaaacaggagaaggagcggcagaaacaggagaaggagcgggagaaggagcggcagaagcaggagaaagagcgagagaagcaggaaaaggagcgagagaagcaggagaaggagcggcagaagcaggagaagaaggctcaaggccggaagctttcgctgcgtcgaaaggcagatgggcccccaggcccccatgatggtggggacaggccctcagccgaggcccggcaggacgcttacttctgacctctgccctggggctggactgcatggcccccctctttccctcagccaagaacaggcctggcccaaggtgccaccccctagcaccttgtcaggctgtcccttgctggggaaagtggcttggttccccatctcctcgccagctgctgatccctacacgggcaggacagatgggcagctgcaaatgagtctggagcctctcatctcccatgaggctcagctggggtctctgtcgctcctgccccagttccctctgggtcccctcctaggtgctgtcctgaatggcccgttgtcatcccaggggtgactcctggtgatgggagtcagcagtttcagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttccataatgctcctgtacccagtttatttaaggggacatgcactggaataggaaatgtcccccatctcccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgg

SEQ ID NO: 31079 - DNA, 1702 bp, Homo sapiens
gtgaggtgctgcgggaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacgggcagcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggaggctgtgcggctggacgccgaggtgttcatggccctgctgcggcggctgcttccgcacgtgcacaagcacctgcagcaggtgggcgtcggacccctgctgtacctgcccgagtggttcctgtgcctcttcgcccgctccctgcccttccccacagtgctgcgtgtctgggatgccttcctcagtgagggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccggcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaac

SEQ ID NO: 31080 - DNA, 1659 bp, Homo sapiens
aggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacgggcagcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggaggctgtgcggctggacgccgaggtgttcatggccctgctgcggcggctgcttccgcacgtgcacaagcacctgcagcaggtgggcgtcggacccctgctgtacctgcccgagtggttcctgtgcctcttcgcccgctccctgcccttccccacagtgctgcgtgtctgggatgccttcctcagtgagggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccggcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccaga

SEQ ID NO: 31081 - DNA, 2159 bp, Homo sapiens
attaccaggcacgcgcaggaaacatggcggcggcgggtgttgtgagcgggaaggtttttggtttcttcttgattcaatcttgataagtagtatgtgtccaggactttatccatactccagtttgttggagtatggtaggagtatgattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcaaggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgctttttt

SEQ ID NO: 31082 - DNA, 1908 bp, Homo sapiens
aaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcaaggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgat

SEQ ID NO: 31083 - DNA, 2489 bp, Homo sapiens
attaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcaaggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagatttaaactaattatttttgtagttacttctaccaaatagcctttccttttcgataacattcctcagtatttttatagccaagtacattttattttcttgctgatgaactggaattggataaatattgcaagtggatgagttggaaattatgcactttgaaaaacattcactttgtttaagcttattgggtttcagatttgattaaattaaatgtggaggctttctatagcattctaagctgagaagtagattgttacccagtaatgaaataaaaaataaaaataaaagg

SEQ ID NO: 31084 - DNA, 5785 bp, Homo sapiens
gttgttgtatgtccgagagacacgtgaggttctgctacgtcattaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaagcaggactgctagacagaagaaagctgttgtgggccattcaccactggaaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcaaggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagatttaaactaattatttttgtagttacttctaccaaatagcctttccttttcgataacattcctcagtatttttatagccaagtacattttattttcttgctgatgaactggaattggataaatattgcaagtggatgagttggaaattatgcactttgaaaaacattcactttgtttaagcttattgggtttcagatttgattaaattaaatgtggaggctttctatagcattctaagctgagaagtagattgttacccagtaatgaaataaaaaataaaaataaaaggatttttttctctattgtttacgacagtactcagcttaaatatttatgctggtcaaatgtgatttaaattggacattttcatcaatgcagtctaatgtgtagataaatatttcaaccataataagtggattggcagtatattttttacattgaacttttcttcacttgtatataaagattatatataagtacttatttatgagtataagaaaggttaggcatattttcattaactgaataaacgacttgatttatataacctggtttatcaaaatttaacatggcttcagtatgagatctttttcaaaactattttcttaaacatttatttcatgagattatgttcaaccctgtacctggtgtaattttaaaattaattgcttgtaacctcactttactaataatgtttattatctttcctaataatgcattaactgattaatcaggtgtttaaatttttataaaatactcttgcaaaaagtttatttgaaaaatttctagatggtctcatgagtttcaaaataataatttttgtgtatgaacaaagctgttgtttttaccatgcagtattgcatgattttaagttatgtggaattaacataactgattttgttttaattgtaagttgttaactcctgtatatatcattaaaataaatctgaagttgaagtagtgtttttagttaaattatacttagaaatagtctgcttttttaaaattttttttcttgagaaagagtcttgctctgttgcccaggctggagtgcagtggcgcagtcctggctcactgcagcctccgccttctgggttcaagcgattctcctgtctcagcctcccgagcagctgggactacaggcttgtgccatcgcgcctgactaatttttgtattttgagtagagatggggtttcaccatgttggccaggctggtctcgaactcttgacctcaagtgatccactcgcttcagcctcccaaagtgctgagattacaggtgtgagccactgtgcccggctaattctttaatagaagaaaaaacatccaagatggacctcaattcatctcttatttttatatgattaaaatgataatctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaatgataatctgaataagttatggaaatgaaaaccatcctttttataactgaaaaaaaattttcattagcatggaaatgggcacagtgttgccttgaaagatacagttatttgactcagtaaagcagcttattacaactgatgctaatagtatagagaaaaaagttgtgcagttctaaaatggtcctagagattgacttttttcccccaagaaagttagggaacaaaacgaacttttttcctggttgagcattaactgacaatcacgacagtagaaccgttagagtttagtttttaatattatgtgtgttatctttcatcagttaataatgagtaagcctattcagaaaaagaacataaactgatcaaaaactcagcatctccagcctttcatttcctgctattcaggaaattgcttagaacatcttgatgtcctccttgttcttcctggacagtgactttttgggagtttgttcctgctgcgtaatgtgatacccacttcagattttttttttatcaatacatttagtaagttgaacttctgtcaagttttattacaaaattacttgttaaaacaatttttactaaactgcatttctatctagcatatttttgatatggaagtgatagtatagtatagttccaggagaagtcttaaatcagtccacagagtccagttagcaaatactctgtgccattaagattgctaaaatacacagttcaggtaaatttactagtgttttttaaaggtttatttgttttcacaagatgctctgtccacacccttataacatgtaaaatattgtgtgctgtattatgtggtaaagttgttaaaattcagtttctaacattaacttaaaagtacagacaatctaacatgatgatttgacttacaaactttcaactaaatttatgatggctttaaagcagtgcactgaatagaaaccatactttgagtacccatacagccatttttcacttttactacaatattctataaatcacatgagatatttaacactttattataaaataggctttgtgttagatgattttgcccaaatgtaaactaatgtagtgttctgagcatgtttaagttagggtaggctaaactatgtttggtaggttagatgtattaaaagcatttttgattaatgatgtcttcaatttatgatgtgtttattggaacataacctcaatataagttgaaaagcatatgtattttcaattctggcatgaacctatgggaatcttttgcatttaagaacctccccattttaataatttcatgggtctaagattcttcatctgtttataaggaactttagtcttagtgattagagactaaatttttttttgagcagtaagaaaacagccttttgggacagatagtgagtgattcttaggaacttgacattgccaagaaattttatagatgccgaagaattcttatgtgaaattcacataagcatgcccattactaaagacagtttgtataaagtaaccctaaatgtttattgaggaacctacagcttcaactgacttacgtgcagatatgtaccaggagaacatcattttagcttgggcgtctttacttggggttttcagaggatccaggaacctcactgtatgcaaagtcttgtggatgtacctgaatgtttttggaggcaggtcacatagtttctgaaagtgttctcttattttcctcaaatgtaggtaaccattgttacaagttatttaacaggagaatagtaacaatgtctaacttatgctaatgattttgtgtgctgagctcccattaattaaaatgtcttcagaa

SEQ ID NO: 31085 - DNA, 3046 bp, Homo sapiens
tggtggtcccgcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccagggagagagccagaggattctccaaagcctgcacccaagccttctctgaccatcagtttcgctcagaaagccaagcgccagaacaacaccttcccattcttttctgaaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggagctgggccggcgggtggaggccctggagcaggagcgggagagcctggcgcacacagcgagcctgcgggagcagcaggtgcaggagctacagcagcacgtgcagctgcttatggacaagaaccacgccaagcagcaggtcatctgcaagctctctgagaaggtcacccaggacttcacgcacccccctgaccagtctcctttgcgccccgacgctgccaacagggacttcctgagccagcaggggaagatagagcacctgaaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaaggtggtgtttcgctatgccttggccattttcaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatcattca

SEQ ID NO: 31086 - DNA, 2097 bp, Homo sapiens
aactgcccagtaggttagttggtatttgccccttttacagatgaggaaacagagggtcagagtggttcagtggcctgcctgaggccttccagccagaacatcagccaggacttaaattcagacctactggtccctttaccacatcatgctgacatcaagaatagagaagggtgctatgagtattttatttttctttcagacttcctcttctgttgccattattggaaatttctaaggaaaagaagctttgggggctcatttgagggtgtgactccccaggaccagggagatgtttatgtccaactgataacatattttactctcttctccaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaaggtggtgtttcgctatgccttggccattttcaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatcattca

SEQ ID NO: 31087 - DNA, 3174 bp, Homo sapiens
gcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaaggccgccaccaagcaagcgatgctgtactggctgcagcagctgcagatgaagcgctgggaattccacaacagcccgccggcacctcctgccacccctgatgccgccctggctgggaatgggcccgtcctgcacctcgagctagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccagggagagagccagaggattctccaaagcctgcacccaagccttctctgaccatcagtttcgctcagaaagccaagcgccagaacaacaccttcccattcttttctgaaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggagctgggccggcgggtggaggccctggagcaggagcgggagagcctggcgcacacagcgagcctgcgggagcagcaggtgcaggagctacagcagcacgtgcagctgcttatggacaagaaccacgccaagcagcaggtcatctgcaagctctctgagaaggtcacccaggacttcacgcacccccctgaccagtctcctttgcgccccgacgctgccaacagggacttcctgagccagcaggggaagatagagcacctgaaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaaggtggtgtttcgctatgccttggccattttcaagtacaacgagaaggagatcttgaggctacagaatggcctggaaatctaccagtacctgcgcttcttcaccaagaccatctccaacagccgctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatcattca

SEQ ID NO: 31088 - DNA, 3198 bp, Homo sapiens
ctccctttgggaagctgcccgccgagtctccgagatttgtccctggtggtcccgcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaaggccgccaccaagcaagcgatgctgtactggctgcagcagctgcagatgaagcgctgggaattccacaacagcccgccggcacctcctgccacccctgatgccgccctggctgggaatgggcccgtcctgcacctcgagctagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccagggagagagccagaggattctccaaagcctgcacccaagccttctctgaccatcagtttcgctcagaaagccaagcgccagaacaacaccttcccattcttttctgaaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggagctgggccggcgggtggaggccctggagcaggagcgggagagcctggcgcacacagcgagcctgcgggagcagcaggtgcaggagctacagcagcacgtgcagctgcttatggacaagaaccacgccaagcagcaggtcatctgcaagctctctgagaaggtcacccaggacttcacgcacccccctgaccagtctcctttgcgccccgacgctgccaacagggacttcctgagccagcaggggaagatagagcacctgaaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatcattca

SEQ ID NO: 31089 - DNA, 4393 bp, Homo sapiens
atgccgagcgggtgctacgtcccgcggtcggagccgcgtcttctcccggctccgccaccagccggggctcgggtgggggccctccggagtgcgcagggcgacggccccacctccggccactgggacggcggcgcggagaaggcagactttaacgccaaaaggaaaaagaaagtggcagagatacaccaggctctgaacagtgatcccactgatgtggctgcccttagacgcatggctatcagtgaaggagggctcctgactgatgagatcagacgaaaagtgtggcccaagctcctcaatgtcaatgccaatgacccacctcctatatcagggaagaacctacggcagatgagcaaggactaccaacaagtgttgctggacgtccggcggtcattgcggcggttccctcctggcatgccagaggaacagagagaagggctccaggaagaactgattgacatcatcctcctcatcttggagcgcaaccctcagctgcactactaccagggctaccatgacattgtggtcacatttctgctggtggtaggcgagaggctggcaacatccctggtagaaaaattatctacccaccacctcagggattttatggatccaacaatggacaacaccaagcatatattaaactatctgatgcccatcattgaccaggtgaatccagagctccatgacttcatgcagagtgctgaggtagggaccatctttgccctcagctggctcatcacctggtttgggcatgtcctgtctgacttcaggcacgtcgtgcggttatatgacttcttcctggcctgccacccactgatgccgatttactttgcagccgtgattgtgttgtatcgcgagcaggaagtcctggactgtgactgtgacatggcctcggtccaccacctgttgtcccagatccctcaggacttgccctatgagacactgatcagcagagcaggagacctttttgttcagtttcccccatccgaacttgctcgggaggccgctgcccaacagcaagctgagaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggtctcacccttccatggaaggattgggaggggtggaatttcctttattaaaagggtttctgtccagagttttttattcctgccaccctgccctgcccgtttgtgtttgcctttacttcagaggccagtagcagagcctacctgacacagaggggacctgggggcctggcacagaatcttatgcctctcccagtgggcttttggatgggctctctgccacctccctggtgttggaggaagtgggtttctgaagcttgcagctgcttttgcaacctgctgggcctgggctgccctagttaccgggaacctcctagtcaccccatagaaggtgaactggaacatgggatgccctcttactgctcctgcttgcctgcatcagatggacacagaaggagggggctgctgctgaaggagtcaggcttgggatggagagcaagaggccaaaggactcgtctgggagcatgatcggcccctcttactagcagctccatcagctgatcagaaatcagagacagaagggaactaggttactcgttaaatcctacctattttcagcctagaaatcacatgggcgtttccagtcaagtgggaaggaagctcatttttagggcctagacctagactagttttgcctgcctttttttcctccctgctttcttctacaagccacacaacattgcttataaaaggtacttttattactatttttagaatatatacaccccatatgtaaattaccctcacttttaaagtaataatagttccttcacggaaaaaaaaatagttctcatcagaaggatgagcttctaagatcctgaattttactttctacttgattaacattttcgctttagccagagttgctatttgcaaacagctttccacttccaaagtgccactttctgaccggtttttcttcctgttttcctcaaatcatcctactcccaaataggcacccactcactaccttggcgtcgttttttgggtctgacttgactcgtcaactgctggtctctcccacctggttggaaatgtcgttggaaacttgcaaagactctccagaccttagggaacaagaggcatcactcagtccttctgggacagcttccctgtaagcaaagccaggtttgttttagattcactctggcctgaaaaaaaaagtgccttttgctgctttaaagaattggggtatatggtatgaagcagccatgtacttgtattttcctggtctttcctgggcactcttctctcttggcagatgttttcttaaagtgaacacaccagaagcactctaccccaccatatccagtcctctttgcatgcctgttgtgtgcagggtggagggtgtcccacgtgccagagcagctgggagccctgtccgctgagttacactaagcactttatttttatttattttattattattttcttttttctgagatggagtctcactctgttgcccaggctggagtgcagtggtgcagtctcagctcactgcaacctccgcctcccaagttcaggcaattctcgctgcctcagcctcccgagtagctgggactacaggcacctgctaccacgcctgactaatttttgtatttttagtagagatggggtttcgccacgttggccaggctggtctcgaactcctgacctcaggtgatctgcccgtctcgtcctcccaaagtgctgggattacaggtgtgagccaccacgcccagccaccactacgcactttaaaaccaaaaaaagctcaaagggatggatcattgtccatggctcaggagccccactgtggggtaagtgtgatgtcgatggattaatttagacagtggtgtattcatcagggcaaaggaaattcttccagaggtgatgatgcggcagatattcccagtgctctcccaaagcaagctggccctcttgtcatcctctcagtgggcggcaccagctgcccctccttccacaagtactcaagcctgtttgtaaatactgaaggaattgatggggttgaggaaaggaggtgcatgtgaccagggtcccaaggccacagcttttcagatcctaggaagcaagtggcatttgcttgagttgtggcctcggaaggagaatgtttatctgttttctaactttgctgacaccaggattctccctgtcattgagaagaaagcattatctaattaccttcaggtggtttacttattctgtaaagaatatgtgtaaatattttgtacagagccctgtatcaaataaacagccatatgtggttactaatcacctcttctgtcattccgtccttggccaccgctcagtgggaatggtctctgatctggatgctcccaccttccatgtcaggcccagaactgtgccatggtctgtggactcctggtcagccttgactggctaggagaccttgggcagtacctacagtcttgctgtttctgtttcatctgcaagaattatgacccacacactccagctgcagcccagggcactgtgatattttatacgtgtgtagatgtttttgtccacagttcctggttcatcactcccataaccctttgttataatgttgggacactgcaggcctcagaaaacggaatctctgtctgtgaccttctcctgccccatttcacttgctcaacaccagactttaatctgactgtagctcataagaccctcattccagagagggtgctgccccatacccggaaggaggaacgctgcacagagaggccaagaagcatctggacagacaggccttgctgggtttagaccttatgctttttgtccagtttcatctcaacacagctgccatgcttcagccatgcctatccaatgacgtctccataaaaggcccaggaacacgggagcttctgaagagctgaacatgtggagggaggggaacgagaacttgtccatgtgccaagagggtggcgcacccccactccatggggacagaagctccagcatttgcccaggacccgtccagacctcaccctgtgtgtatcttcatctggctgtttacttatttgtatccttttctaataatgtttgtaataaactggtaaacataa

SEQ ID NO: 31090 - DNA, 4466 bp, Homo sapiens
agcggggcgcctgcgcgcctgcgcgccgctggccgacggaggggagcctgccgatgccgagcgggtgctacgtcccgcggtcggagccgcgtcttctcccggctccgccaccagccggggctcgggtgggggcccggggccccggggcatggccctccggagtgcgcagggcgacggccccacctccggccactgggacggcggcgcggagaaggcagactttaacgccaaaaggaaaaagaaagtggcagagatacaccaggctctgaacagtgatcccactgatgtggctgcccttagacgcatggctatcagtgaaggagggctcctgactgatgagatcagacgaaaagtgtggcccaagctcctcaatgtcaatgccaatgacccacctcctatatcagggaagaacctacggcagatgagcaaggactaccaacaagtgttgctggacgtccggcggtcattgcggcggttccctcctggcatgccagaggaacagagagaagggctccaggaagaactgattgacatcatcctcctcatcttggagcgcaaccctcagctgcactactaccagggctaccatgacattgtggtcacatttctgctggtggtaggcgagaggctggcaacatccctggtagaaaaattatctacccaccacctcagggattttatggatccaacaatggacaacaccaagcatatattaaactatctgatgcccatcattgaccaggtgaatccagagctccatgacttcatgcagagtgctgaggtagggaccatctttgccctcagctggctcatcacctggtttgggcatgtcctgtctgacttcaggcacgtcgtgcggttatatgacttcttcctggcctgccacccactgatgccgatttactttgcagccgtgattgtgttgtatcgcgagcaggaagtcctggactgtgactgtgacatggcctcggtccaccacctgttgtcccagatccctcaggacttgccctatgagacactgatcagcagagcaggagacctttttgttcagtttcccccatccgaacttgctcgggaggccgctgcccaacagcaagctgagaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggtctcacccttccatggaaggattgggaggggtggaatttcctttattaaaagggtttctgtccagagttttttattcctgccaccctgccctgcccgtttgtgtttgcctttacttcagaggccagtagcagagcctacctgacacagaggggacctgggggcctggcacagaatcttatgcctctcccagtgggcttttggatgggctctctgccacctccctggtgttggaggaagtgggtttctgaagcttgcagctgcttttgcaacctgctgggcctgggctgccctagttaccgggaacctcctagtcaccccatagaaggtgaactggaacatgggatgccctcttactgctcctgcttgcctgcatcagatggacacagaaggagggggctgctgctgaaggagtcaggcttgggatggagagcaagaggccaaaggactcgtctgggagcatgatcggcccctcttactagcagctccatcagctgatcagaaatcagagacagaagggaactaggttactcgttaaatcctacctattttcagcctagaaatcacatgggcgtttccagtcaagtgggaaggaagctcatttttagggcctagacctagactagttttgcctgcctttttttcctccctgctttcttctacaagccacacaacattgcttataaaaggtacttttattactatttttagaatatatacaccccatatgtaaattaccctcacttttaaagtaataatagttccttcacggaaaaaaaaatagttctcatcagaaggatgagcttctaagatcctgaattttactttctacttgattaacattttcgctttagccagagttgctatttgcaaacagctttccacttccaaagtgccactttctgaccggtttttcttcctgttttcctcaaatcatcctactcccaaataggcacccactcactaccttggcgtcgttttttgggtctgacttgactcgtcaactgctggtctctcccacctggttggaaatgtcgttggaaacttgcaaagactctccagaccttagggaacaagaggcatcactcagtccttctgggacagcttccctgtaagcaaagccaggtttgttttagattcactctggcctgaaaaaaaaagtgccttttgctgctttaaagaattggggtatatggtatgaagcagccatgtacttgtattttcctggtctttcctgggcactcttctctcttggcagatgttttcttaaagtgaacacaccagaagcactctaccccaccatatccagtcctctttgcatgcctgttgtgtgcagggtggagggtgtcccacgtgccagagcagctgggagccctgtccgctgagttacactaagcactttatttttatttattttattattattttcttttttctgagatggagtctcactctgttgcccaggctggagtgcagtggtgcagtctcagctcactgcaacctccgcctcccaagttcaggcaattctcgctgcctcagcctcccgagtagctgggactacaggcacctgctaccacgcctgactaatttttgtatttttagtagagatggggtttcgccacgttggccaggctggtctcgaactcctgacctcaggtgatctgcccgtctcgtcctcccaaagtgctgggattacaggtgtgagccaccacgcccagccaccactacgcactttaaaaccaaaaaaagctcaaagggatggatcattgtccatggctcaggagccccactgtggggtaagtgtgatgtcgatggattaatttagacagtggtgtattcatcagggcaaaggaaattcttccagaggtgatgatgcggcagatattcccagtgctctcccaaagcaagctggccctcttgtcatcctctcagtgggcggcaccagctgcccctccttccacaagtactcaagcctgtttgtaaatactgaaggaattgatggggttgaggaaaggaggtgcatgtgaccagggtcccaaggccacagcttttcagatcctaggaagcaagtggcatttgcttgagttgtggcctcggaaggagaatgtttatctgttttctaactttgctgacaccaggattctccctgtcattgagaagaaagcattatctaattaccttcaggtggtttacttattctgtaaagaatatgtgtaaatattttgtacagagccctgtatcaaataaacagccatatgtggttactaatcacctcttctgtcattccgtccttggccaccgctcagtgggaatggtctctgatctggatgctcccaccttccatgtcaggcccagaactgtgccatggtctgtggactcctggtcagccttgactggctaggagaccttgggcagtacctacagtcttgctgtttctgtttcatctgcaagaattatgacccacacactccagctgcagcccagggcactgtgatattttatacgtgtgtagatgtttttgtccacagttcctggttcatcactcccataaccctttgttataatgttgggacactgcaggcctcagaaaacggaatctctgtctgtgaccttctcctgccccatttcacttgctcaacaccagactttaatctgactgtagctcataagaccctcattccagagagggtgctgccccatacccggaaggaggaacgctgcacagagaggccaagaagcatctggacagacaggccttgctgggtttagaccttatgctttttgtccagtttcatctcaacacagctgccatgcttcagccatgcctatccaatgacgtctccataaaaggcccaggaacacgggagcttctgaagagctgaacatgtggagggaggggaacgagaacttgtccatgtgccaagagggtggcgcacccccactccatggggacagaagctccagcatttgcccaggacccgtccagacctcaccctgtgtgtatcttcatctggctgtttacttatttgtatccttttctaataatgtttgtaataaactggtaaacataa

SEQ ID NO: 31091 - DNA, 2024 bp, Homo sapiens
gcgccgctggccgacggaggggagcctgccgatgccgagcgggtgctacgtcccgcggtcggagccgcgtcttctcccggctccgccaccagccggggctcgggtgggggcccggggccccggggcatggccctccggagtgcgcagggcgacggccccacctccggccactgggacggcggcgcggagaaggcagactttaacgccaaaaggaaaaagaaagtggcagagatacaccaggctctgaacagtgatcccactgatgtggctgcccttagacgcatggctatcagtgaaggagggctcctgactgatgagatcagacgaaaagtgtggcccaagctcctcaatgtcaatgccaatgacccacctcctatatcagggaagaacctacggcagatgagcaaggactaccaacaagtgttgctggacgtccggcggtcattgcggcggttccctcctggcatgccagaggaacagagagaagggctccaggaagaactgattgacatcatcctcctcatcttggagcgcaaccctcagctgcactactaccagggctaccatgacattgtggtcacatttctgctggtggtaggcgagaggctggcaacatccctggtagaaaaattatctacccaccacctcagggattttatggatccaacaatggacaacaccaagcatatattaaactatctgatgcccatcattgaccaggtgaatccagagctccatgacttcatgcagagtgctgaggtagggaccatctttgccctcagctggctcatcacctggtttgggcatgtcctgtctgacttcaggcacgtcgtgcggttatatgacttcttcctggcctgccacccactgatgccgatttactttgcagccgtgattgtgttgtatcgcgagcaggaagtcctggactgtgactgtgacatggcctcggtccaccacctgttgtcccagatccctcaggacttgccctatgagacactgatcagcagagcaggagacctttttgttcagtttcccccatccgaacttgctcgggaggccgctgcccaacagcaagctgagaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggcacccactcactaccttggcgtcgttttttgggtctgacttgactcgtcaactgctggtctctcccacctggttggaaatgtcgttggaaacttgcaaagactctccagaccttagggaacaagaggcatcactcagtccttctgggacagcttccctgcctcagaaaacggaatctctgtctgtgaccttctcctgccccatttcacttgctcaacaccagactttaatctgactgtagctcataagaccctcattccagagagggtgctgccccatacccggaaggaggaacgctgcacagagaggccaagaagcatctggacagacaggccttgctgggtttagaccttatgctttttgtccagtttcatctcaacacagctgccatgcttcagccatgcctatccaatgacgtctccataaaaggcccaggaacacgggagcttctgaagagctgaacatgtggagggaggggaacgagaacttgtccatgtgccaagagggtggcgcacccccactccatggggacagaagctccagcatttgcccaggacccgtccagacctcaccctgtgtgtatcttcatctggctgtttacttatttgtatccttttctaataatgtttgtaataaactggtaaacataa

SEQ ID NO: 31092 - DNA, 4329 bp, Homo sapiens
gctgaggagaaagcggcgcgcggagggtgtgagatggcagacaggtttgcaggaaaccctcagaaagggggctggaggatttagccactctgtcctccccttccggcagtccagggcctcctcccgagcacagcggcgctatggactctccaggatacaactgcttcgtggacaaagacaagatggacgctgccatccaggacctggggcccaaggagctgagctgcactgaactgcaggaactgaagcagctggcgcgccagggctactgggcccaaagccacgccctgcggggaaaggtgtaccagcgcctgatccgggacattccctgccgcacggtcacgcctgacgccagcgtgtacagcgacatcgtgggcaagatcgtgggcaagcacagcagcagctgcctgccgctgcccgagttcgtggacaacacgcaggtgcccagctactgcctgaatgcacgcggcgagggggccgtgcgcaagatcctcctgtgcctggccaaccagttccccgacatctccttctgccccgccctgccggccgtggtggccctgctgctgcactacagcatcgacgaggccgagtgcttcgagaaggcctgccgcatcctggcctgcaatgaccccggcaggaggctgatcgaccagagcttcctggcctttgagtcgtcctgcatgacgtttggggacctggtgaacaagtactgccaggcggcccacaagctgatggtggccgtgtcggaggatgtcctgcaggtctatgcggactggcagcgctggctgtttggggagctgcccctctgctacttcgcccgggtctttgacgtcttcctggtggagggctacaaggtgctgtaccgcgtggcgctggccatcctcaagttcttccacaaggtgagggccgggcagccgctggagtcggacagcgtgaagcaggacatccgcacgttcgtcagagacatcgcgaagacggtgtcccctgagaagctgctggagaaagcgttcgccatccgcctcttctcccgcaaggagatccagctcctgcagatggccaatgagaaagccctgaagcagaagggcatcaccgtgaagcagaagaggcagtttgtacacttggccgtccatgcagagaacttccgctcggagatcgtcagcgtgagggagatgagagacatctggtcctgggtccccgagcgctttgccctgtgccagccccttctgctgttctcctccctgcagcacgggtacagcctggccaggttctacttccagtgtgaaggacatgagcctaccctcttgctcatcaagaccacgcagaaggaggtgtgtggtgcttacctgtccacagactggagtgagagaaataagtttggaggcaaactgggcttctttgggaccggagaatgctttgtgtttaggctgcagcctgaggtgcagcgctacgagtgggtggtgatcaagcaccccgagctgaccaagcccccacccttgatggctgccgagcccaccgccccactcagccactccgcctcctcagaccccgctgaccgcctctcgcccttcctggccgctcgccacttcaacctgccctccaagaccgagtccatgttcatggcggggggcagcgactgcctcatcgtcgggggaggaggcggccaggcgctctacatcgatggggacctgaaccggggccgcacaagccactgcgacaccttcaacaaccagcccctctgctccgagaacttcctcattgctgccgtggaggcctggggcttccaggaccctgacacccagtgacggcctgtgccacggtgactgagccgtggtggggcggtgggccgaggctgggctgccgcctcgggcagcagagagcagatgaaacccccatgtggtaggcagggttgggggacggcaggaccccatggccaagcctggcgttgcctggacctgctgctgcctctacctggggtttgggctgggcttccccagtccacctgcatctgggtcagagctggagggcctgctgtgcccccagccccacccagagctggcataggaagtaccttcctcctccgtggaggcttccatagcccaaggccttgggagtgtctgggtcttgctgcccctgagcctctctaggcagcctgagcccctggggtgggagtacaacggcagtgggaacgtgcagctaagggtgggcctgtggtgccccctgctggtgccgcatagcatcgcgccctcctgagcagggccctgcagcctggctggctggcgactgaatcccagcgtagatcccgagaacagactggcacccttgggcctgccccctggcggaccccaccccctgtcctgggcgtttgccccagttccctccccaggcctcctgggccacctctcacattaacccttcttggctgcctctgaggctcccctgggctgcgtttgggagctgctgggtgggaggaggagggtgggatttgtgctgggctccacccccagggagggtgggagctggagggggatgtcacatgtccttgtgtttctgcagagcctgaagcttttgctgggcctccctgcgtgttcccatctgaagaggtagccccgggagaggccctcagggaccgacccagaccagcaagctccatttccaggggtctgcccagagaagcctggacccagggggcttctcagctcccctcccttccagcccaggcctccttgagctcctgtagcctctgcagctgcccatttcacctctttgtcattgcaatgacctggggcccagggtcacgcccaagcccctctttgtggcatgctcatctcagtgcagccccaactgcttctctgcaccaggccccgtgccctcccctggccctggccacacagcacctccttggccaccttgcatggatgcatgtcctccctctgtccctcttgtggtgctgtggctggccacgtgtcagggttttctgtgagcctctcaccttacagcctttgggcccctgggcccctgccctgcctgagccctgcgctggccagacgcaggtaggtgccaggggaggccttgcctctgggcactatagggggcagccccctgccttgtgacctccctccatgccccatgacctccttcaactcgtcttgagggtctggtcaccacggaggggagaagggagacacagaggcccaagtggctgttctgggaccatggaagcctgggtcacagaggcaggtaccagcagtcctgcccccacccccgtccctgctggcctccagccagtgccacttggagtcccctgcaccgtgccactttccatccccacaccattgcctgctcctcccatggggctttagcctcccctgaccatctgctcatgtagcctctgactgggcgcacagtggtgcaggaggaaggaccgggaaccctgtgtggctttgggcaagctgacaaacccgtctggaactcagtttccccagctgtgaaatggggccagtccccatgccctgctgtcctcctcacaggactgttgagaggctcgcagggggatggggtgaatccctctcacggggagaggtatgggagggaagtcgccactcatctcagcccaccgcagccctccaggcccccgcctgagcccctgaggccctcatctgtaccgccagctttggtgttcattaaacatggtcttgctgcatcaactccagggctccaagctgagtctgatctcttcagccagaggggcctccgggggcttcctgggcctacagccaagcaggtgtgggaggctgcccgctgtagtgctcacccacattctatgactggaatgctgcaagcctcttccagagggagccctccaggagcagggaagtcatatccgtggaccatttgtaggtttccctctgcaaacttcctgaactgggtggtgatttttctggcgagttaagtccagcaggttctgcgtggctgcccccagggggccccacccgggccttccagtgatctggaccaggaagacggattgctgctgggtcatgatttccacatcatgagcgaagttctttgttttttgtgtgcatgcaaaatattgtttctttaaatttaatatcttttcctaacttttctactaacctagaaggtatgtgtgattattatcttttttattcttatcactgtacttgttagtatctgatattaggtattcccaaatagaacataatttattttgttaatgttctctatttcttcttgattatttattagctttggatgttaaaaattagccaaaagtggctgctctgcctatgaagtagccattctttgttt

SEQ ID NO: 31093 - DNA, 2423 bp, Homo sapiens
actctgtcctccccttccggcagtccagggcctcctcccgagcacagcggcgctatggactctccaggatacaactgcttcgtggacaaagacaagatggacgctgccatccaggacctggggcccaaggagctgagctgcactgaactgcaggaactgaagcagctggcgcgccagggctactgggcccaaagccacgccctgcggggaaaggtgtaccagcgcctgatccgggacattccctgccgcacggtcacgcctgacgccagcgtgtacagcgacatcgtgggcaagatcgtgggcaagcacagcagcagctgcctgccgctgcccgagttcgtggacaacacgcaggtgcccagctactgcctgaatgcacgcggcgagggggccgtgcgcaagatcctcctgtgcctggccaaccagttccccgacatctccttctgccccgccctgccggccgtggtggccctgctgctgcactacagcatcgacgaggccgagtgcttcgagaaggcctgccgcatcctggcctgcaatgaccccggcaggaggctgatcgaccagagcttcctggcctttgagtcgtcctgcatgacgtttggggacctggtgaacaagtactgccaggcggcccacaagctgatggtggccgtgtcggaggatgtcctgcaggtctatgcggactggcagcgctggctgtttggggagctgcccctctgctacttcgcccgggtctttgacgtcttcctggtggagggctacaaggtgctgtaccgcgtggcgctggccatcctcaagttcttccacaaggtgagggccgggcagccgctggagtcggacagcgtgaagcaggacatccgcacgttcgtcagagacatcgcgaagacggtgtcccctgagaagctgctggagaaagcgttcgccatccgcctcttctcccgcaaggagatccagctcctgcagatggccaatgagaaagccctgaagcagaagggcatcaccgtgaagcagaagagtgtgtcactttctaaaaggcagtttgtacacttggccgtccatgcagagaacttccgctcggagatcgtcagcgtgagggagatgagagacatctggtcctgggtccccgagcgctttgccctgtgccagccccttctgctgttctcctccctgcagcacgggtacagcctggccaggttctacttccagtgtgaaggacatgagcctaccctcttgctcatcaagaccacgcagaaggaggtgtgtggtgcttacctgtccacagactggagtgagagaaataagtttggaggcaaactgggcttctttgggaccggagaatgctttgtgtttaggctgcagcctgaggtgcagcgctacgagtgggtggtgatcaagcaccccgagctgaccaagcccccacccttgatggctgccgagcccaccgccccactcagccactccgcctcctcagaccccgctgaccgcctctcgcccttcctggccgctcgccacttcaacctgccctccaagaccgagtccatgttcatggcggggggcagcgactgcctcatcgtcgggggaggaggcggccaggcgctctacatcgatggggacctgaaccggggccgcacaagccactgcgacaccttcaacaaccagcccctctgctccgagaacttcctcattgctgccgtggaggcctggggcttccaggaccctgacacccagtgacggcctgtgccacggtgactgagccgtggtggggcggtgggccgaggctgggctgccgcctcgggcagcagagagcagatgaaacccccatgtggtaggcagggttgggggacggcaggaccccatggccaagcctggcgttgcctggacctgctgctgcctctacctggggtttgggctgggcttccccagtccacctgcatctgggtcagagctggagggcctgctgtgcccccagccccacccagagctggcataggaagtaccttcctcctccgtggaggcttccatagcccaaggccttgggagtgtctgggtcttgctgcccctgagcctctctaggcagcctgagcccctggggtgggagtacaacggcagtgggaacgtgcagctaagggtgggcctgtggtgccccctgctggtgccgcatagcatcgcgccctcctgagcagggccctgcagcctggctggctggcgactgaatcccagcgtagatcccgagaacagactggcacccttgggcctgccccctggcggaccccaccccctgtcctgggcgtttgccccagttccctccccaggcctcctgggccacctctcacattaacccttcttggctgcctctgaggctcccctgggctgcgtttgggagctgctgggtgggaggaggagggtgggatttgtgctgg

SEQ ID NO: 31094 - DNA, 4042 bp, Homo sapiens
cgtcagtttaacacctccgtgaatccggaagtatgctgtcaaaacaaccaaaccacggggctgggggaggcggggcctcagtaggcgtctgcacgctagctgaaatagagcaaaatgcccgacttttgggggcggggctcctggcaacagcactctaggcgcaggcgcagaggcgacctccaggcagggccaggtgggagggacggtggggggtagggtcgcgcggcgccctctgcgcctgcgccccggcacgaggtggggcggcgggcgtcagtacagtagagtgtgcgccggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaagaaatgtgagagcttcttgccgccagagttccgctcttttgctgtagatccccagatcacctcgctcgacgtgttgcagcacatcctcatccgagcctttgatttgagtgggaagaagaactttggcatcagctacctgggccgggaccggctaggacaggaagtttacctctcacttctatctgactgggacctcagcacagcctttgccactgcctccaaaccttacctgcaattgcgtgtagatattcggccctcggaggacagcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgcacacatgaaggtcactgtggtttgtgtgtttctctgcctcctccctgggttttgctgtagatggagtcctcaggggccctttacctgatggaggggaaatacttcacttggtggagagaggctccagcttcccccttgtgatggggagagtggatgctgacaatcagttcccaaaggtgagcccaggtggagcactgcttgaggaaggcctgagtctgtttttttggtacatccatcggcctgtaagggtctgtattatggctgtgaatatatgttttcaggacagccccctggatgagagataagagagttcctggctcaaaaaaggacaagattctttactgagattgggaagtatgggctacttagaaacgttggagcagccacccctggcattccacatgtcaccatttctaggatcttggcctctctgtgaggtttatgcaccaatgctggcagccctgggcaggggcctcggcctcctttttgttttccacttcagacaggtaccgtgcagatgttaacaaggtttgagcgaggtgcatctcacacaagtgtgaaagcccaatcatcacattgttgaattacaaaaggatctagggctcctattcttgtcacttgctttggagccagtttgaaagactggcctagcccatgcctagcggccctaaactgggattccagctcacagcacctgtcttaaccatttcagcagtagaaaccacttatttaccttctccatctcactaatatggacaaacaacaagcactgataaaacgcaggccctaatagaattcacttcgttatttggaggataatgatcaaaaaaaggtcctttttcccactgacatgctcagagggtgggattctctcacaggccaggtgctgtcatccacaaaggatgggtgaaataactggggtcctcaggtcacggtctagccacaccagcttctcccaagtactaaccaggcttgaccctgcttagcttcagaggtcagacaagatctggcatgttcaggatggtatggctgtagaccaggctgggttctggccagagctgttgcactaggcaatgctgccagagatgaggaggcatcagggcagtcatcccttctgctgtttgccccaagaatgccatacaaacctggggatgacccttaaaagtctcccgtcacccccagtattggggggaagctgactattcctcagatgatagcccagtcacttgaagaacaggacaagactattctgtgtctagggggctcaagcactgtgtgtgggtctaacgaatgcattttgtggaaatgggctcagactccccaaagggccatccaacctatgggagtgtctggccttctgaggtcctgaaatgtctcttttgtcagtaaacagctaataccctc

SEQ ID NO: 31095 - DNA, 691 bp, Homo sapiens
atggcaacagcctccggggcctcggacttgtctggctccggagcgcccccgcccggtgtgggagctcaggcggcggcggccgctgaggaggaggagcgagaggtggtgcgggtccgagtcaagcatggtgatggggcccctggtggcctaccccatgtcttctctccccagaaatgtgagagcttcttgccgccagagttccgctcttttgctgtagatccccagatcacctcgctcgacgtgttgcagcacatcctcatccgagcctttgatttgagtgggaagaagaactttggcatcagctacctgggccgggaccggctaggacaggaagtttacctctcacttctatctgactgggacctcagcacagcctttgccactgcctccaaaccttacctgcaattgcgtgtagatattcggccctcggaggacagcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctct

SEQ ID NO: 31096 - DNA, 2035 bp, Homo sapiens
aacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaagaaatgtgagagcttcttgccgccagagttccgctcttttgctgtagatccccagatcacctcgctcgacgtgttgcagcacatcctcatccgagcctttgatttgagtgggcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccc

SEQ ID NO: 31097 - DNA, 2128 bp, Homo sapiens
agtacagtagagtgtgcgccggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaagaaatgtgagagcttcttgccgccagagttccgctcttttgctgtagatccccagatcacctcgctcgacgtgttgcagcacatcctcatccgagcctttgatttgagtgggaagaagaactttggcatcagctacctgggccgggaccggctaggacaggaagtttacctctcacttctatctgactgggacctcagcacagcctttgccactgcctccaaaccttacctgcaattgcgtgtagatattcggccctcggaggacagtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagag

SEQ ID NO: 31098 - DNA, 1899 bp, Homo sapiens
gcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcagagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatg

SEQ ID NO: 31099 - DNA, 2122 bp, Homo sapiens
gaatgtcactggtgcttagcacctatctgctctctggcctgcctcagtggtctacagcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatga

SEQ ID NO: 31100 - DNA, 1876 bp, Homo sapiens
agttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacgtaagcgggacattaaggaagcatatattcttcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatg

SEQ ID NO: 31101 - DNA, 2647 bp, Homo sapiens
cttttgcctcgagtattcccaggagggacggtccatccagctgttctccaggaccaaggacccactgttcttcctcagtgacccaggaaaatgaagcctcctcctgttgggacggctcagaatggtggactccacagtccctccgcgagagacgtggtttccatgcgtacaatagatcttcctcatcccccaaacccaacaccctcctgctcaacaggcgttattcctaaagtggcttcactgttcagactgaagagccacggtagccaaagtgatgagcggagtagaaccgagcagtcgggagagatcttgttccctgtaggaaactgggcatcgctgaggccctgagcatcccaggaggccgattgcacagagacctctggtcgctgaccccagtctgcctccacatccctggaatagcccatcatgggcccttcacccttggcaggtggaaaccattcaacctgctggggccggtgtgtccccatttcatggcattgggggacaacaggattctctgtctaggtcccactgtactcaagtccttgggaagatgcccacccctgcttgggacttgagactccagagactggagcagctgtgggccactgggtctggcccctttttccctgggggcggcggtggaatgggggttacgcagccagccagcatctgggagcccggcgagagcggttcaggtgttctccgaagccgccgcgtacagtgtgacctttagacaattctgtctcacaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcagatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttg

SEQ ID NO: 31102 - DNA, 2448 bp, Homo sapiens
ttgtgaaggtgccatggagaactgggaccttgttacttatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccgcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttg

SEQ ID NO: 31103 - DNA, 2581 bp, Homo sapiens
cttttgcctcgagtattcccaggagggacggtccatccagctgttctccaggaccaaggacccactgttcttcctcagtgacccaggaaaatgaagcctcctcctgttgggacggctcagaatggtggactccacagtccctccgcgagagacgtggtttccatgcgtacaatagatcttcctcatcccccaaacccaacaccctcctgctcaacaggcgttattcctaaagtggcttcactgttcagactgaagagccacggtagccaaagtgatgagcggagtagaaccgagcagtcgggagagatcttgttccctgtaggaaactgggcatcgctgaggccctgagcatcccaggaggccgattgcacagagacctctggtcgctgaccccagtctgcctccacatccctggaatagcccatcatgggcccttcacccttggcaggtggaaaccattcaacctgctggggccggtgtgtccccatttcatggcattgggggacaacaggattctctgtctaggtcccactgtactcaagtccttgggaagatgcccacccctgcttgggacttgagactccagagactggagcagctgtgggccactgggtctggcccctttttccctgggggcggcggtggaatgggggttacgcagccagccagcatctgggagcccggcgagagcggttcaggtgttctccgaagccgccgcgtacagtgtgacctttagacaattctgtctcacaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctattttcctgaggaggatgcattctgggcactggtgcagctgctggccagtgagaggcactccctgcagggatttcacagcccaaatggcgggaccgtccaggggctccaagaccaacaggagcatgtggtagccacgtcacaatccaagaccatggggcatcagatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtatgctcccacctcagggccttgcctctgcggcctccacttggaaagttctcagttccctccaggcttctagaagcatctgggccagggctcatggctggataatttccctaggcttaacaacccaagcaagcttcgcgtcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcct

SEQ ID NO: 31104 - DNA, 1964 bp, Homo sapiens
atggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctattttcctgaggaggatgcattctgggcactggtgcagctgctggccagtgagaggcactccctgcagggatttcacagcccaaatggcgggaccgtccaggggctccaagaccaacaggagcatgtggtagccacgtcacaatccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtatgctcccacctcagggccttgcctctgcggcctccacttggaaagttctcagttccctccaggcttctagaagcatctgggccagggctcatggctggataatttccctaggcttaacaacccaagcaagcttcgcgtcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtactttaaactcatggaaggataactaccttcacgttttgaaataaatgtttcctgttgaaatg

SEQ ID NO: 31105 - DNA, 2039 bp, Homo sapiens
gtgcttagcacctatctgctctctggcctgcgtcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctattttcctgaggaggatgcattctgggcactggtgcagctgctggccagtgagaggcactccctgcagggatttcacagcccaaatggcgggaccgtccaggggctccaagaccaacaggagcatgtggtagccacgtcacaatccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtatgctcccacctcagggccttgcctctgcggcctccacttggaaagttctcagttccctccaggcttctagaagcatctgggccagggctcatggctggataatttccctaggcttaacaacccaagcaagcttcgcgtcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcct

SEQ ID NO: 31106 - DNA, 2305 bp, Homo sapiens
gaatgtcactggtgcttagcacctgtctgctctctggcctgcctcagtggtctacagcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaatccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcctggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatgattttagattttagacagaaatattgaaaaggcactatagtatcctcctataccttccatccagctgcccctaataatgatgttttgcagtcccatggcacataagaaatttaggccgggtgtggtggctcacacctgtaatcccagcaatttgagaggtcgaggcgggaggttcaggttcact

SEQ ID NO: 31107 - DNA, 2647 bp, Homo sapiens
cttttgcctcgagtattcccaggagggacggtccatccagctgttctccaggaccaaggacccactgttcttcctcagtgacccaggaaaatgaagcctcctcctgttgggacggctcagaatggtggactccacagtccctccgcgagagacgtggtttccatgcgtacaatagatcttcctcatcccccaaacccaacaccctcctgctcaacaggcgttattcctaaagtggcttcactgttcagactgaagagccacggtagccaaagtgatgagcggagtagaaccgagcagtcgggagagatcttgttccctgtaggaaactgggcatcgctgaggccctgagcatcccaggaggccgattgcacagagacctctggtcgctgaccccagtctgcctccacatccctggaatagcccatcatgggcccttcacccttggcaggtggaaaccattcaacctgctggggccggtgtgtccccatttcatggcattgggggacaacaggattctctgtctaggtcccactgtactcaagtccttgggaagatgcccacccctgcttgggacttgagactccagagactggagcagctgtgggccactgggtctggcccctttttccctgggggcggcggtggaatgggggttacgcagccagccagcatctgggagcccggcgagagcggttcaggtgttctccgaagccgccgcgtacagtgtgacctttagacaattctgtctcacaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaatccaagaccatggggcatcagatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcctggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttg

SEQ ID NO: 31108 - DNA, 2042 bp, Homo sapiens
ctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaatccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcctggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatga

SEQ ID NO: 31109 - DNA, 2108 bp, Homo sapiens
gtgcttagcacctatctgctctctggcctgcctcagtggtctacagcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaa

SEQ ID NO: 31110 - DNA, 1899 bp, Homo sapiens
gcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcagagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatg

SEQ ID NO: 31111 - DNA, 1876 bp, Homo sapiens
agttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatg

SEQ ID NO: 31112 - DNA, 3389 bp, Homo sapiens
gtggggcccatctagggagccggtgggaatggagactgggctaggtcaggcccctgggcgctcagcagttctgtcggcaagtgagcacaagaggagcggggcagcctgagggtctggccctgtctacttggagacaaccccggtgagatgcaagggttatggccacagggtgaggggacgcctggcccagcctcagggctgttgtccagcaggtctctgagggcccacctgcccctgttctcccccattcccctagagctacagccctcactgtcccgtgaggggaaaaggcatggtgacaatgggggctgtagccctaggagaacgggggagaagatgggcagggccccgttctgggcatctcacggtgaggccagggaggcagcagggctcgcggctaaagacctgggtctggtgctgggaagggatctggggccgggtaagaggagcccagccaggagcccatccctcagggatcacaggatggagagacagaggatccctggggaggtagggcgggagggagctgacgagccgtgccacttctgaaacgcagggtgtgtggcccgggtgcagggagaggcaggtggatgctgggaggtcagaacctgcaagggccttggggctgtcaagtggggtgggcccctggtgcagccagagtacaccgggcaggtctcagggcaggctcccttgaccctggcggggggatgtggtcactccctgagggactcctgtcagggcccggtcgcccaccctgggcggcccccatcccatctcagggctaacctttctcagctccagcagaaagcaccacctcgagtccaggacgggcagccccattgggcagcctgaccgccccccacgccaggggccccagtaaccccggccaggctgtccctacactccttcttctcccaggtcctgcccctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaaggtaagagcctgatgcgtggaggggctggtccagggacgtagggactgggcgggtggtcagtgaggcagaggaagcagctggcctgagcggtggcgggtgagggcaacacgctgtcactgggaggggcagcagtccctgctggacctgaccccaggttgctgttcactttggcagtttgataaaattccaaaaggagaaccacagtcctggcttgggggtggctgcgcgcttgtgtcaggaccccacctagaggctgggacctaagactggtgtgtctgtggcctgaggatggtacatcccggggtcccaaagccagcccactggtgctcatttgctcaaaggctctcagcccttgaggtctgcccttccctggctccttccagctggctcccaccagggctccagagcccaagacccagcatccgcgggcggctctgggaagcctggcagctccgctaactccaacatgcctcatttgacagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatg

SEQ ID NO: 31113 - DNA, 2305 bp, Homo sapiens
gaatgtcactggtgcttagcacctatctgctctctggcctgcgtcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccagcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcaccccaagccccacgaccatcgttctgaattctgacgacaccgtgagcctgcctttgtacttcaaactcatggaaggataaccaccttcatgttttgaaataaatgtttcctgttgaaatgattttagattttagacagaaatattgaaaaggcactatagtatcctcctataccttccatccagctgcccctaataatgatgttttgcagtcccatggcacataagaaatttaggccgggtgtggtggctcacacctgtaatcccagcaatttgagaggtcgaggcgggaggttcaggttcact

SEQ ID NO: 31114 - DNA, 2110 bp, Homo sapiens
gtgcttagcacctatctgctctctggcctgcgtcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagaggggccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcgtcctcgttttatttttggttaaacttatgaatatgtattaagaaagagtgcagcttgagagacattcagagatggaacacaccagaccccagatcacaaagccaaccatgcccagcccctcccagcaccccaagccccacgaccatcgttctgaattctgacgacaccgtgagcctgcctttgtactttaaactcatggaaggataactaccttcacgttttgaaataaatgtttcctgttgaaatg

SEQ ID NO: 31115 - DNA, 2652 bp, Homo sapiens
cttttgcctcgagtattcccaggagggacggtccatccagctgttctccaggaccaaggacccactgttcttcctcagtgacccaggaaaatgaagcctcctcctgttgggacggctcagaatggtggactccacagtccctccgcgagagacgtggtttccatgcgtacaatagatcttcctcatcccccaaacccaacaccctcctgctcaacaggcgttattcctaaagtggcttcactgttcagactgaagagccacggtagccaaagtgatgagcggagtagaaccgagcagtcgggagagatcttgttccctgtaggaaactgggcatcgctgaggccctgagcatcccaggaggccgattgcacagagacctctggtcgctgaccccagtctgcctccacatccctggaatagcccatcatgggcccttcacccttggcaggtggaaaccattcaacctgctggggccggtgtgtccccatttcatggcattgggggacaacaggattctctgtctaggtcccactgtactcaagtccttgggaagatgcccacccctgcttgggacttgagactccagagactggagcagctgtgggccactgggtctggcccctttttccctgggggcggcggtggaatgggggttacgcagccagccagcatctgggagcccggcgagagcggttcaggtgttctccgaagccgccgcgtacagtgtgacctttagacaattctgtctcacaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcagatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagaggggccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcgtcctcgttttatttttggttaaacttatgaatatgtattaagaaagagtgcagcttgagagacattcagagatggaacacaccagaccccagatcacaaagccaaccatgcccagcccctcccagcaccccaagccccacgaccatcgttctgaattctgacgacaccgtgagcctgcctttgtactttaaactcatggaaggataactaccttcacgttttgaaataaatgtttcctgttgaaatg

SEQ ID NO: 31116 - DNA, 2647 bp, Homo sapiens
cttttgcctcgagtattcccaggagggacggtccatccagctgttctccaggaccaaggacccactgttcttcctcagtgacccaggaaaatgaagcctcctcctgttgggacggctcagaatggtggactccacagtccctccgcgagagacgtggtttccatgcgtacaatagatcttcctcatcccccaaacccaacaccctcctgctcaacaggcgttattcctaaagtggcttcactgttcagactgaagagccacggtagccaaagtgatgagcggagtagaaccgagcagtcgggagagatcttgttccctgtaggaaactgggcatcgctgaggccctgagcatcccaggaggccgattgcacagagacctctggtcgctgaccccagtctgcctccacatccctggaatagcccatcatgggcccttcacccttggcaggtggaaaccattcaacctgctggggccggtgtgtccccatttcatggcattgggggacaacaggattctctgtctaggtcccactgtactcaagtccttgggaagatgcccacccctgcttgggacttgagactccagagactggagcagctgtgggccactgggtctggcccctttttccctgggggcggcggtggaatgggggttacgcagccagccagcatctgggagcccggcgagagcggttcaggtgttctccgaagccgccgcgtacagtgtgacctttagacaattctgtctcacaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcagatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccagcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcaccccaagccccacgaccatcgttctgaattctgacgacaccgtgagcctgcctttgtacttcaaactcatggaaggataaccaccttcatgttttgaaataaatgtttcctgttg

SEQ ID NO: 31117 - DNA, 3389 bp, Homo sapiens
gtggggcccatctagggagccggtgggaatggagactgggctaggtcaggcccctgggcgctcagcagttctgtcggcaagtgagcacaagaggagcggggcagcctgagggtctggccctgtctacttggagacaaccccggtgagatgcaagggttatggccacagggtgaggggacgcctggcccagcctcagggctgttgtccagcaggtctctgagggcccacctgcccctgttctcccccattcccctagagctacagccctcactgtcccgtgaggggaaaaggcatggtgacaatgggggctgtagccctaggagaacgggggagaagatgggcagggccccgttctgggcatctcacggtgaggccagggaggcagcagggctcgcggctaaagacctgggtctggtgctgggaagggatctggggccgggtaagaggagcccagccaggagcccatccctcagggatcacaggatggagagacagaggatccctggggaggtagggcgggagggagctgacgagccgtgccacttctgaaacgcagggtgtgtggctcgggtgcagggagaggcaggtggatgctgggaggtcagaacctgcaagggccttggggctgtcaagtggggtgggcccctggtgcagccagagtacaccgggcaggtctcagggcaggctcccttgaccctggcggggggatgtggtcactccctgagggactcctgtcagggcccggtcgcccaccctgggcggcccccatcccatctcagggctaacctttctcagctccagcagaaagcaccacctcgagtccaggacgggcagccccactgggcagcctgaccgccccccacgccaggggccccagtaaccccggccaggctgtccctacactccttcttctcccaggtcctgcccctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaaggtaagagcctgatgcgtggaggggctggtccagggacgtagggactgggcgggtggtcagtgaggcagaggaagcagctggcctgagcggtggcgggtgagggcaacacgctgtcactgggaggggcagcagtccctgctggacctgaccccaggttgctgttcactttggcagtttgataaaattccaaaaggagaaccacagtcctggcttgggggtggctgcgcgcttgtgtcaggaccccacctagaggctgggacctaagactggtgtgtctgtggcctgaggatggtacatcccggggtcccaaagccagcccactggtgctcatttgctcaaaggctctcagcccttgaggtctgcccttccctggctccttccagctggctcccaccagggctccagagcccaagacccagcatccgcgggcggctctgggaagcctggcagctccgctaactccaacatgcctcatttgacagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccagcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcaccccaagccccacgaccatcgttctgaattctgacgacaccgtgagcctgcctttgtacttcaaactcatggaaggataaccaccttcatgttttgaaataaatgtttcctgttgaaatg

SEQ ID NO: 31118 - DNA, 2255 bp, Homo sapiens
gtcagtggtctacagcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccaagctgggctgccagaggacaaggggcctaagccttttcgaagctacaacaacaacgtcgatcatttggggattgtacagtcgggtcaacctcctttccagggacagaactcctccctgactcccctgcaggtccagcccgaggttgttaggccagaggtgtggggcccatctagggagccggtgggaatggagactgggctaggtcaggcccctgggcgctcagcagttctgtcggcaagtgagcacaagaggagcggggcagcctgagggtctggccctgtctacttggagacaaacccgtgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcctggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatgga

SEQ ID NO: 31119 - DNA, 2105 bp, Homo sapiens
gtgcttagcacctgtctgctctctggcctgcctcagtggtctacagcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccaagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccagcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcaccccaagccccacgaccatcgttctgaattctgacgacaccgtgagcctgcctttgtacttcaaactcatggaaggataaccaccttcatgttttgaaataaatgtttcctgttg

SEQ ID NO: 31120 - DNA, 3389 bp, Homo sapiens
gtggggcccatctagggagccggtgggaatggagactgggctaggtcaggcccctgggcgctcagcagttctgtcggcaagtgagcacaagaggagcggggcagcctgagggtctggccctgtctacttggagacaaccccggtgagatgcaagggttatggccacagggtgaggggacgcctggcccagcctcagggctgttgtccagcaggtctctgagggcccacctgcccctgttctcccccattcccctagagctacagccctcactgtcccgtgaggggaaaaggcatggtgacaatgggggctgtagccctaggagaacgggggagaagatgggcagggccccgttctgggcatctcacggtgaggccagggaggcagcagggctcgcggctaaagacctgggtctggtgctgggaagggatctggggccgggtaagaggagcccagccaggagcccatccctcagggatcacaggatggagagacagaggatccctggggaggtagggcgggagggagctgacgagccgtgccacttctgaaacgcagggtgtgtggctcgggtgcagggagaggcaggtggatgctgggaggtcagaacctgcaagggccttggggctgtcaagtggggtgggcccctggtgcagccagagtacaccgggcaggtctcagggcaggctcccttgaccctggcggggggatgtggtcactccctgagggactcctgtcagggcccggtcgcccaccctgggcggcccccatcccatctcagggctaacctttctcagctccagcagaaagcaccacctcgagtccaggacgggcagccccactgggcagcctgaccgccccccacgccaggggccccagtaaccccggccaggctgtccctacactccttcttctcccaggtcctgcccctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaaggtaagagcctgatgcgtggaggggctggtccagggacgtagggactgggcgggtggtcagtgaggcagaggaagcagctggcctgagcggtggcgggtgagggcaacacgctgtcactgggaggggcagcagtccctgctggacctgaccccaggttgctgttcactttggcagtttgataaaattccaaaaggagaaccacagtcctggcttgggggtggctgcgcgcttgtgtcaggaccccacctagaggctgggacctaagactggtgtgtctgtggcctgaggatggtacatcccggggtcccaaagccagcccactggtgctcatttgctcaaaggctctcagcccttgaggtctgcccttccctggctccttccagctggctcccaccagggctccagagcccaagacccagcatccgcgggcggctctgggaagcctggcagctccgctaactccaacatgcctcatttgacagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcctggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatg

SEQ ID NO: 31121 - DNA, 6174 bp, Homo sapiens
gcggccgcggggaccctcggcgtggtcctctgaccctgcaaacccgcgacggaggaaggggaggtcctgcccgaggcgccagcccaaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggcagttggcacagtttcggcggcgccttctgcgcgggagtggggggcgcggtgcgcccggccggcctccgcggtgccctggtgaggcgagagttatggagccgcccagctgcattcaggatgagccgttcccgcaccccctggagcccgagccgggcgtctcagctcagcccggccccgggaagccaagcgataagcggttccggctgtggtacgttggggggtcgtgcctggaccacaggaccacgctgcctatgctgccctggctcatggccgagatccgcaggcgcagccagaagcccgaggcgggcggctgcggggcgccggcggcccgagaggtgatcctggtgctcagcgcgcccttcctgcgttgcgtccccgcgccgggcgctggggcctcggggggcactagtccgtcggccacgcagcccaacccggcggtattcatcttcgagcacaaggcgcagcatatctcgcgcttcatccacaacagccacgacctcacctactttgcctacctgatcaaggcgcagcccgacgaccccgagtcgcagatggcctgccacgttttccgcgccacagaccccagccaggttcctgatgttattagcagcataaggcaattatctaaagcggccatgaaagaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggggagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttgtattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagcgcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagcttt

SEQ ID NO: 31122 - DNA, 6364 bp, Homo sapiens
gcggccgcggggaccctcggcgtggtcctctgaccctgcaaacccgcgacggaggaaggggaggtcctgcccgaggcgccagcccaaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggcagttggcacagtttcggcggcgccttctgcgcgggagtggggggcgcggtgcgcccggccggcctccgcggtgccctggtgaggcgagagttatggagccgcccagctgcattcaggatgagccgttcccgcaccccctggagcccgagccgggcgtctcagctcagcccggccccgggaagccaagcgataagcggttccggctgtggtacgttggggggtcgtgcctggaccacaggaccacgctgcctatgctgccctggctcatggccgagatccgcaggcgcagccagaagcccgaggcgggcggctgcggggcgccggcggcccgagaggtgatcctggtgctcagcgcgcccttcctgcgttgcgtccccgcgccgggcgctggggcctcggggggcactagtccgtcggccacgcagcccaacccggcggtattcatcttcgagcacaaggcgcagcatatctcgcgcttcatccacaacagccacgacctcacctactttgcctacctgatcaaggcgcagcccgacgaccccgagtcgcagatggcctgccacgttttccgcgccacagaccccagccaggttcctgatgttattagcagcataaggcaattatctaaagcggccatgaaagaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggggagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagcaatctttcgtcagttcgacgcatgtacaaggagagtaattcttcctccagtcttccaagtcttcacacttccttctctgccccttccttcactgccccctctttcctgaaaagcttttaccagaattcaggtagactgtccccacagtatgaaaatgaaatcagacaagacactgcttcagaatcaagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttgtattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagcgcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttc

SEQ ID NO: 31123 - DNA, 847 bp, Homo sapiens
gataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttgtattcctgtctggggaggatgacccagaaaagattgaagaaagaa

SEQ ID NO: 31124 - DNA, 6204 bp, Homo sapiens
gcggccgcggggaccctcggcgtggtcctctgaccctgcaaacccgcgacggaggaaggggaggtcctgcccgaggcgccagcccaaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggcagttggcacagtttcggcggcgccttctgcgcgggagtggggggcgcggtgcgcccggccggcctccgcggtgccctggtgaggcgagagttatggagccgcccagctgcattcaggatgagccgttcccgcaccccctggagcccgagccgggcgtctcagctcagcccggccccgggaagccaagcgataagcggttccggctgtggtacgttggggggtcgtgcctggaccacaggaccacgctgcctatgctgccctggctcatggccgagatccgcaggcgcagccagaagcccgaggcgggcggctgcggggcgccggcggcccgagaggtgatcctggtgctcagcgcgcccttcctgcgttgcgtccccgcgccgggcgctggggcctcggggggcactagtccgtcggccacgcagcccaacccggcggtattcatcttcgagcacaaggcgcagcatatctcgcgcttcatccacaacagccacgacctcacctactttgcctacctgatcaaggcgcagcccgacgaccccgagtcgcagatggcctgccacgttttccgcgccacagaccccagccaggttcctgatgttattagcagcataaggcaattatctaaagcggccatgaaagaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggggagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagcaatctttcgtcagttcgacgcatgtacaaggagagtaattcttcctccagtcttccaagtcttcacacttccttctctgccccttccttcactgccccctctttcctgaaaagcttttaccagaattcaggtagactgtccccacagtatgaaaatgaaatcagacaagacactgcttcagaatcaagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttgtattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagcgcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagcttt

SEQ ID NO: 31125 - DNA, 6339 bp, Homo sapiens
gcggccgcggggaccctcggcgtggtcctctgaccctgcaaacccgcgacggaggaaggggaggtcctgcccgaggcgccagcccaaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggcagttggcacagtttcggcggcgccttctgcgcgggagtggggggcgcggtgcgcccggccggcctccgcggtgccctggtgaggcgagagttatggagccgcccagctgcattcaggatgagccgttcccgcaccccctggagcccgagccgggcgtctcagctcagcccggccccgggaagccaagcgataagcggttccggctgtggtacgttggggggtcgtgcctggaccacaggaccacgctgcctatgctgccctggctcatggccgagatccgcaggcgcagccagaagcccgaggcgggcggctgcggggcgccggcggcccgagaggtgatcctggtgctcagcgcgcccttcctgcgttgcgtccccgcgccgggcgctggggcctcggggggcactagtccgtcggccacgcagcccaacccggcggtattcatcttcgagcacaaggcgcagcatatctcgcgcttcatccacaacagccacgacctcacctactttgcctacctgatcaaggcgcagcccgacgaccccgagtcgcagatggcctgccacgttttccgcgccacagaccccagccaggttcctgatgttattagcagcataaggcaattatctaaagcggccatgaaagaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggggagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagcaatctttcgtcagttcgacgcatgtacaaggagagtaattcttcctccagtcttccaagtcttcacacttccttctctgccccttccttcactgccccctctttcctgaaaagcttttaccagaattcaggtagactgtccccacagtatgaaaatgaaatcagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttgtattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagcgcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagcttt

SEQ ID NO: 31126 - DNA, 1465 bp, Homo sapiens
ccggcagggggagcgaggaggaagggaaccgcggccgggccagcggaggcggcggagcgcaccgcccaccagggctcagggtcctccgaccgggtgaagcttcgctggctgccaggatccccggcagggatgcacttcagcaccgtcaccagggacatggaagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggcggatgtttcccaccttccaagtgaagctcttcggcatggatcccatggccgactatatgctgctcatggacttcgtgccggtggacgataagcgctaccggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcggatcacgcagctcaagattgccagcaatcccttcgcgaaaggcttccgggactgtgaccctgaggactggccccggaaccaccggcccggcgcactgccgctcatgagcgccttcgcgcgctcgcggaaccccgtggcttccccgacgcagcccagcggcacggagaaaggtggacatgtcctgaaggacaaggaagtgaaagctgagacgtctaggaacacaccagagagagaagtggagcttctgagggatgcaggtggctgtgtgaacctggggctcccctgccccgcagagtgccaacccttcaatacccagggcctggtggctgggaggaccgcaggtgaccgtctttgttgaatgctgaggccgggccatgggcacatggagttgtcgtgtttcccttcactttggttcatgtttgaaatttccaaaattaaaaaaacagtgacttgttcagtaaattccaatatgaataaagtgcatgttttgtaataaa

SEQ ID NO: 31127 - DNA, 2082 bp, Homo sapiens
ccggcagggggagcgaggaggaagggaaccgcggccgggccagcggaggcggcggagcgcaccgcccaccagggctcagggtcctccgaccgggtgaagcttcgctggctgccaggatccccggcagggatgcacttcagcaccgtcaccagggacatggaagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggcggatgtttcccaccttccaagtgaagctcttcggcatggatcccatggccgactatatgctgctcatggacttcgtgccggtggacgataagcgctaccggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcggatcacgcagctcaagattgccagcaatcccttcgcgaaaggcttccgggactgtgaccctgaggactggccccggaaccaccggcccggcgcactgccgctcatgagcgccttcgcgcgctcgcggaaccccgtggcttccccgacgcagcccagcggcacggagaaagacgcggctgaggcccggcgagaattccagcgcgacgcgggcgggccagcagtgctcggggacccggcgcatcctccgcagctgctggcccgggtgctaagcccctcgctgcccggggccggcggcgccggcggcttagtcccgctgcccggcgcgcccggaggccggcccagtcccccgaaccccgagctgcgcctggaggcgcccggcgcatcggagccgctgcaccaccacccctacaaatatccggccgccgcctacgaccactatctcggggccaagagccggccggcgccctacccgctgcccggcctgcgtggccacggctaccacccgcacgcgcatccgcaccaccaccaccaccccgtgagtccagccgccgcggccgccgccgccgctgccgcagctgccgcggccgccaacatgtactcgtcggccggagccgcgccgcccggctcctacgactattgccccagataacacgggccctgtcgcgctcccgccccggtcctgcacagccccgaagttcgccgggcccggccaccctgccccaagggcaagcaaggaatacgttcccccagccccaggggccaccgcggctctccccttccccagcctcgaagccatgggggccccctcgccacccccagccccttgggctatcgaagtatccggttccccagtccctggagccaccgcgggtccttccccggccccgagggccaagggggtccccgcccgccagtgccaaagcgcccggtcggaggcggaaggaagtgatatttattgttctccccgagaccgcgtcgcccgcggcccggccggcagttgcagtgtagacagcccgagagccccgcctgcaggcggtgtagatacatgtagatactgtagatactgtagataccgccccggcgccgacttgataaacggtttcgcctcttttgg

SEQ ID NO: 31128 - DNA, 1538 bp, Homo sapiens
ccggcagggggagcgaggaggaagggaaccgcggccgggccagcggaggcggcggagcgcaccgcccaccagggctcagggtcctccgaccgggtgaagcttcgctggctgccaggatccccggcagggatgcacttcagcaccgtcaccagggacatggaagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggcggatgtttcccaccttccaagtgaagctcttcggcatggatcccatggccgactatatgctgctcatggacttcgtgccggtggacgataagcgctaccggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcggatcacgcagctcaagattgccagcaatcccttcgcgaaaggcttccgggactgtgaccctgaggactggccccggaaccaccggcccggcgcactgccgctcatgagcgccttcgcgcgctcgcggaaccccgtggcttccccgacgcagcccagcggcacggagaaagggctggtcacagaaggctctgggctccaacctggcttgctggacgtgctcttgaagcccccaagtaagaagtctgagtccctgagaccaccacactgcaaggacacttgaaggtactcaggtttcagagcccaagtcaggaggtcaagtgtgcatgcaagaggtggcaggggacagatgtgctgctgttcccaggccacctgcacagctggatggtggaagcagttcacttaaaggccatgagttactcgggaggctgaggcaggaggatcacttgagcctattagttggaggctgcagtaagctatgatcatgccactgcactccagcctgggtgacagagtgagacccccactgtccctggtctcttaaaagaaaaaacaaacaaacaaaccaaaaaa

SEQ ID NO: 31129 - DNA, 1548 bp, Homo sapiens
acgagtggtgaccaccccttccagcaggcaggttcccagccccagccaagcagtgtttctccaggagccggacagcctctctgtctccatggcagccttcctatctgctggcctcggcatacttgcaccctcagagacctaccccctacctacaaccagctctggctgggagccccggctggggtcaccattcccatcaggcccttgcaccagctctactggggcccaagctgtggccgagcccactgggcagggccccaagaacccacgtgtgtccagagtgacagttcagctggagatgaagcctctgtgggaggaattcaaccagctgggcactgagatgatcgtcaccaaggcaggcaggaggatgttcccccccttccaggtgaagatcctgggcatggactccctggccgactacgccctgctcatggacttcatccccctggacgacaagagatacaggtatgccttccacagctcggcctggctggtggcgggcaaggcagacccagccacacctggccgcgtgcacttccaccccgactcgccagccaagggtgcccagtggatgcgccagattgtgtcctttgacaagctcaagctgaccaacaacctgctggatgacaatggccacatcattctcaactctatgcaccgctaccagccccgtttccacgtggtcttcgtggacccacgcaaggacagtgagcgctatgcccaggagaacttcaagtccttcatcttcacagagacccagttcacagcagtgacagcctatcagaaccacaggatcacccagctgaaaatcgccagcaacccttttgccaaaggctttagagagagtgacctggactcctggcctgtggccccacggcccctgctcagtgtcccagcccggagtcacagcagcctcagtccctgtgtgctgaagggtgccacagacagggagaaagaccccaacaaagcttcagcttccacctccaagacccctgcttggctccatcatcagctgctgcccccacctgaggtcctgctggccccggccacctacaggcctgtcacgtatcagagcctgtactctggagccccgagccacctagggatcccaaggacccgaccagcaccataccccctccccaacatccgggctgatagggatcaaggaggcctgcctctcccagctgggctggggctcctgtcccccactgtggtgtgcctggggcctggccaggactcccagtgatgccagaagccctggggggaagccctgctaccctggaccttacaccgggtgtgggaatcagcctctgccccgccccctccagccccatctctgtctcaaggagagcagggtaggtgaaagtctagagaaagaggctacctgcccagggtcacagcaaggctgggaccatggcaagcttggaaccaggacttctatctcccaaccccagcagcctgaatactgtgccctcttgctttgggggtaactcccgaaaaccctgccttacctctcccttccccctaacattaaactatttggcatga

SEQ ID NO: 31130 - DNA, 3492 bp, Homo sapiens
tctttccggcttctttgcaaaaggatagaaccgtctcgaccagggcactaggactggaagatcgggctgtgtctaggccgctgtccgcgaaatccgagacgttttttcagcttggctaggaccgacttcgctgccggtttgagctttctctgcactcgggggtctcctgccgtcctcgaccggtggcgtaacttgggaagagattctgagcagagcactggttcagattctgaggtcctcactgagcggacttcctgctccttcagtactcacactgacctggcctctggtgctgcaggccctgtgcctgctgccatgtcttccatggaggagattcaggtggagctgcaatgtgctgacctctggaagcggttccatgatattggaactgaaatgatcatcaccaaagcaggcaggaggatgtttcctgccatgagagtgaaaatcactggcctagatccacatcagcagtactacatagcaatggacattgtgcctgtggacaataaaagatacagatatgtgtatcatagctccaagtggatggtggctggcaatgctgattcccctgtgcccccaagagtttatatacaccctgattctctagcttctggagacacctggatgagacaggtggtcagttttgacaaactcaagcttaccaacaatgagttggatgatcaaggacatatcattctgcactctatgcacaaataccagcctcgagttcatgtgattcgcaaagacttcagcagtgacctttcacccactaagcctgttcctgttggggatggggtgaaaacgttcaactttcctgagactgtgttcaccacagttacggcctatcagaatcagcagattaccagattaaaaattgaccgaaacccttttgctaaaggattcagagattctgggagaaacagaactggacttgaagccatcatggagacatatgcattctggagacctcctgtgcgcacactcaccttcgaagacttcaccaccatgcagaagcagcaaggaggcagcacaggcacttccccaaccacctccagcactgggacaccatccccttcggcttcttctcatcttttatctccatcctgttctcctccaacttttcatctggcccccaacactttcaatgtgggctgccgagaaagccagctgtgtaatctaaacctctctgattatccaccatgtgcccgaagcaacatggctgccttgcagagctacccagggctgagtgacagtggctacaacaggcttcagagtggcaccacttcagccactcagccctctgaaaccttcatgcctcagaggactccatccctgatctcaggaataccaactcctccctcgttgcctggcaacagcaagatggaagcctacggtggccagctggggtcctttcccacttcccagtttcagtatgtcatgcaggcaggcaatgctgcctccagctcctcatcaccacacatgttcgggggcagccacatgcagcagagctcctacaatgccttctcccttcacaacccttacaacctgtatggatacaatttccccacttcccctaggctagctgcaagcccggaaaaactgagcgcctctcaaagcactttactctgttcttctccttccaacggggcctttggagagaggcagtacctgccgtcagggatggagcacagcatgcacatgattagcccttcacccaataaccaacaggcaaccaacacttgtgatggccggcagtatggggcagttccaggctcctcctcccagatgtccgtgcacatggtttaaaggccagtccaaacaccacggagcatttggcaatcaaggccccagagtctccgtggtcagatcctcctctttgggagtccagtgtctttgaaaaacaggaaccgtgttttttttttttttttttttctggccgaagacatatacccaagaacaagagatacctttaagccagtgaaggatacttgcgatagaatcatccgcaactcagtggccattcttctgccttcccagaccttagttttataaagcattgtctgttccagagtggcctttgaagagactgaataatcacttcgtcataatgttaagggagatgctagtgtgtggcagccatgaaaagttacacatacacacccacatacagacagacctacctatacatacgtgcacacacacatacatattcatacacaattcatacacatgcaatcatacatgcacactgactctgaactgggtgaactctgtggagggaggcccagaatgggtgctttcaccaagaatttgtctgtgtacaactctagatggagtgggccagcagtagctgccagtctttctcccctgcagcttcctctgcttctggaatgaaccatgtatcctggagaccctcccaatggatgagagtggaaagacatcagtacaactggacttggcttccggaaaaagattgcttttgaactttggctctcttcacttgtatgctatcattgatattcccagtggtgcccgtggaaagagggagaaagagaagctgaacaggagaaagacaaacagaaagaatagagaacaggaacgaggtggagagcaagactgacagagaaagtgtgagcaatgatgagaattttaattcaccaaggagacgtgtttttggtttgtccccccaaaccccgcccgccccactacaggttatggaaagaatcatggcattactgaggagtaaacctctctggcacactgagcatggtcagggcattggtcagagggacagagcaaggaatgcatcctgagcccacagctttgaccactgtgatccagaagagaggtgcactacgtgggaagtgctgattccacagcatgcagcctggtaggggaaggaaaataaaagggtgtgaagaaggaatagttttataatctcggaagatgataccaagagcagaggcaacaaatagaggcctggcctccaggtgccggatccagacacctgacctagaatgcctgcccgctatccctgtggcaggaaatatcccctcatgtcccagggaattgcagatgggtcttctatacccttctacctgcccttagatctccatttttatcaaatagtacattgcattttgaagttttgggttttgtccttcatctttccctttcccttcaaatcttttaatggtaagaaagcaagtgaagcttggtgcaagctaaaatttttaaatggtgtggaaatgcaaataataccaagtaaaataatacagatattattaaagtttctggttttgaggtgttgtagataaatgtatttatgtgcctagtggggaatccaatattatgaatatgaaaaagggggcaataaaagggtatgtaaaatatgtatgaagaaaaggtgtacaaaaatttgcccttatgcacggaactctgtttctaagtgccaagcacagaaagccgctaaataaaatctttgcaattgtt

SEQ ID NO: 31131 - DNA, 3594 bp, Homo sapiens
tctttccggcttctttgcaaaaggatagaaccgtctcgaccagggcactaggactggaagatcgggctgtgtctaggccgctgtccgcgaaatccgagacgttttttcagcttggctaggaccgacttcgctgccggtttgagctttctctgcactcgggggtctcctgccgtcctcgaccggtggcgtaacttgggaagagattctgagcagagcactggttcagattctgaggtcctcactgagcggacttcctgctccttcagtactcacactgacctggcctctggtgctgcaggccctgtgcctgctgccatgtcttccatggaggagattcaggtggagctgcaatgtgctgacctctggaagcggttccatgatattggaactgaaatgatcatcaccaaagcaggcaggaggatgtttcctgccatgagagtgaaaatcactggcctagatccacatcagcagtactacatagcaatggacattgtgcctgtggacaataaaagatacagatatgtgtatcatagctccaagtggatggtggctggcaatgctgattcccctgtgcccccaagagtttatatacaccctgattctctagcttctggagacacctggatgagacaggtggtcagttttgacaaactcaagcttaccaacaatgagttggatgatcaaggacatatcattctgcactctatgcacaaataccagcctcgagttcatgtgattcgcaaagacttcagcagtgacctttcacccactaagcctgttcctgttggggatggggtgaaaacgttcaactttcctgagactgtgttcaccacagttacggcctatcagaatcagcagattaccagattaaaaattgaccgaaacccttttgctaaaggattcagagattctgggagaaacagaactggacttgaagccatcatggagacatatgcattctggagacctcctgtgcgcacactcaccttcgaagacttcaccaccatgcagaagcagcaagcctcaaagaagacttctcaaggatacacagtgaatcagcactcctcagagacagatgccattgaattatacgagagaagagtctggctcatggaacgaagaggcagcacaggcacttccccaaccacctccagcactgggacaccatccccttcggcttcttctcatcttttatctccatcctgttctcctccaacttttcatctggcccccaacactttcaatgtgggctgccgagaaagccagctgtgtaatctaaacctctctgattatccaccatgtgcccgaagcaacatggctgccttgcagagctacccagggctgagtgacagtggctacaacaggcttcagagtggcaccacttcagccactcagccctctgaaaccttcatgcctcagaggactccatccctgatctcaggaataccaactcctccctcgttgcctggcaacagcaagatggaagcctacggtggccagctggggtcctttcccacttcccagtttcagtatgtcatgcaggcaggcaatgctgcctccagctcctcatcaccacacatgttcgggggcagccacatgcagcagagctcctacaatgccttctcccttcacaacccttacaacctgtatggatacaatttccccacttcccctaggctagctgcaagcccggaaaaactgagcgcctctcaaagcactttactctgttcttctccttccaacggggcctttggagagaggcagtacctgccgtcagggatggagcacagcatgcacatgattagcccttcacccaataaccaacaggcaaccaacacttgtgatggccggcagtatggggcagttccaggctcctcctcccagatgtccgtgcacatggtttaaaggccagtccaaacaccacggagcatttggcaatcaaggccccagagtctccgtggtcagatcctcctctttgggagtccagtgtctttgaaaaacaggaaccgtgttttttttttttttttttttctggccgaagacatatacccaagaacaagagatacctttaagccagtgaaggatacttgcgatagaatcatccgcaactcagtggccattcttctgccttcccagaccttagttttataaagcattgtctgttccagagtggcctttgaagagactgaataatcacttcgtcataatgttaagggagatgctagtgtgtggcagccatgaaaagttacacatacacacccacatacagacagacctacctatacatacgtgcacacacacatacatattcatacacaattcatacacatgcaatcatacatgcacactgactctgaactgggtgaactctgtggagggaggcccagaatgggtgctttcaccaagaatttgtctgtgtacaactctagatggagtgggccagcagtagctgccagtctttctcccctgcagcttcctctgcttctggaatgaaccatgtatcctggagaccctcccaatggatgagagtggaaagacatcagtacaactggacttggcttccggaaaaagattgcttttgaactttggctctcttcacttgtatgctatcattgatattcccagtggtgcccgtggaaagagggagaaagagaagctgaacaggagaaagacaaacagaaagaatagagaacaggaacgaggtggagagcaagactgacagagaaagtgtgagcaatgatgagaattttaattcaccaaggagacgtgtttttggtttgtccccccaaaccccgcccgccccactacaggttatggaaagaatcatggcattactgaggagtaaacctctctggcacactgagcatggtcagggcattggtcagagggacagagcaaggaatgcatcctgagcccacagctttgaccactgtgatccagaagagaggtgcactacgtgggaagtgctgattccacagcatgcagcctggtaggggaaggaaaataaaagggtgtgaagaaggaatagttttataatctcggaagatgataccaagagcagaggcaacaaatagaggcctggcctccaggtgccggatccagacacctgacctagaatgcctgcccgctatccctgtggcaggaaatatcccctcatgtcccagggaattgcagatgggtcttctatacccttctacctgcccttagatctccatttttatcaaatagtacattgcattttgaagttttgggttttgtccttcatctttccctttcccttcaaatcttttaatggtaagaaagcaagtgaagcttggtgcaagctaaaatttttaaatggtgtggaaatgcaaataataccaagtaaaataatacagatattattaaagtttctggttttgaggtgttgtagataaatgtatttatgtgcctagtggggaatccaatattatgaatatgaaaaagggggcaataaaagggtatgtaaaatatgtatgaagaaaaggtgtacaaaaatttgcccttatgcacggaactctgtttctaagtgccaagcacagaaagccgctaaataaaatctttgcaattgttttc

SEQ ID NO: 31132 - DNA, 3504 bp, Homo sapiens
ggcggctaaaatgagtgaaaggagaagatctgcagtcgccctgagctcgcgagcacatgccttctccgttgaagccttgatcggctcaaataaaaaacggaaactgcgagactgggaggagaaggggctggacctgtctatggaggcgctgagccccgcgggcccactcggagacacggaggacgcggcggcacacggcctggagcctcacccggattctgagcagagcactggttcagattctgaggtcctcactgagcggacttcctgctccttcagtactcacactgacctggcctctggtgctgcaggccctgtgcctgctgccatgtcttccatggaggagattcaggtggagctgcaatgtgctgacctctggaagcggttccatgatattggaactgaaatgatcatcaccaaagcaggcaggaggatgtttcctgccatgagagtgaaaatcactggcctagatccacatcagcagtactacatagcaatggacattgtgcctgtggacaataaaagatacagatatgtgtatcatagctccaagtggatggtggctggcaatgctgattcccctgtgcccccaagagtttatatacaccctgattctctagcttctggagacacctggatgagacaggtggtcagttttgacaaactcaagcttaccaacaatgagttggatgatcaaggacatatcattctgcactctatgcacaaataccagcctcgagttcatgtgattcgcaaagacttcagcagtgacctttcacccactaagcctgttcctgttggggatggggtgaaaacgttcaactttcctgagactgtgttcaccacagttacggcctatcagaatcagcagattaccagattaaaaattgaccgaaacccttttgctaaaggattcagagattctgggagaaacagaactggacttgaagccatcatggagacatatgcattctggagacctcctgtgcgcacactcaccttcgaagacttcaccaccatgcagaagcagcaaggaggcagcacaggcacttccccaaccacctccagcactgggacaccatccccttcggcttcttctcatcttttatctccatcctgttctcctccaacttttcatctggcccccaacactttcaatgtgggctgccgagaaagccagctgtgtaatctaaacctctctgattatccaccatgtgcccgaagcaacatggctgccttgcagagctacccagggctgagtgacagtggctacaacaggcttcagagtggcaccacttcagccactcagccctctgaaaccttcatgcctcagaggactccatccctgatctcaggaataccaactcctccctcgttgcctggcaacagcaagatggaagcctacggtggccagctggggtcctttcccacttcccagtttcagtatgtcatgcaggcaggcaatgctgcctccagctcctcatcaccacacatgttcgggggcagccacatgcagcagagctcctacaatgccttctcccttcacaacccttacaacctgtatggatacaatttccccacttcccctaggctagctgcaagcccggaaaaactgagcgcctctcaaagcactttactctgttcttctccttccaacggggcctttggagagaggcagtacctgccgtcagggatggagcacagcatgcacatgattagcccttcacccaataaccaacaggcaaccaacacttgtgatggccggcagtatggggcagttccaggctcctcctcccagatgtccgtgcacatggtttaaaggccagtccaaacaccacggagcatttggcaatcaaggccccagagtctccgtggtcagatcctcctctttgggagtccagtgtctttgaaaaacaggaaccgtgttttttttttttttttttttctggccgaagacatatacccaagaacaagagatacctttaagccagtgaaggatacttgcgatagaatcatccgcaactcagtggccattcttctgccttcccagaccttagttttataaagcattgtctgttccagagtggcctttgaagagactgaataatcacttcgtcataatgttaagggagatgctagtgtgtggcagccatgaaaagttacacatacacacccacatacagacagacctacctatacatacgtgcacacacacatacatattcatacacaattcatacacatgcaatcatacatgcacactgactctgaactgggtgaactctgtggagggaggcccagaatgggtgctttcaccaagaatttgtctgtgtacaactctagatggagtgggccagcagtagctgccagtctttctcccctgcagcttcctctgcttctggaatgaaccatgtatcctggagaccctcccaatggatgagagtggaaagacatcagtacaactggacttggcttccggaaaaagattgcttttgaactttggctctcttcacttgtatgctatcattgatattcccagtggtgcccgtggaaagagggagaaagagaagctgaacaggagaaagacaaacagaaagaatagagaacaggaacgaggtggagagcaagactgacagagaaagtgtgagcaatgatgagaattttaattcaccaaggagacgtgtttttggtttgtccccccaaaccccgcccgccccactacaggttatggaaagaatcatggcattactgaggagtaaacctctctggcacactgagcatggtcagggcattggtcagagggacagagcaaggaatgcatcctgagcccacagctttgaccactgtgatccagaagagaggtgcactacgtgggaagtgctgattccacagcatgcagcctggtaggggaaggaaaataaaagggtgtgaagaaggaatagttttataatctcggaagatgataccaagagcagaggcaacaaatagaggcctggcctccaggtgccggatccagacacctgacctagaatgcctgcccgctatccctgtggcaggaaatatcccctcatgtcccagggaattgcagatgggtcttctatacccttctacctgcccttagatctccatttttatcaaatagtacattgcattttgaagttttgggttttgtccttcatctttccctttcccttcaaatcttttaatggtaagaaagcaagtgaagcttggtgcaagctaaaatttttaaatggtgtggaaatgcaaataataccaagtaaaataatacagatattattaaagtttctggttttgaggtgttgtagataaatgtatttatgtgcctagtggggaatccaatattatgaatatgaaaaagggggcaataaaagggtatgtaaaatatgtatgaagaaaaggtgtacaaaaatttgcccttatgcacggaactctgtttctaagtgccaagcacagaaagccgctaaataaaatctttgcaattgt

SEQ ID NO: 31133 - DNA, 762 bp, Homo sapiens
agagtcagaactggacttgaagccatcatggagacatatgcattctggagacctcctgtgcgcacactcaccttcgaagacttcaccaccatgcagaagcagcaagcctcaaagaagacttctcaaggatacacagtgaatcagcactcctcagagacagatgccattgaattatacgagagaagagtctggctcatggaacgaagaggcagcacaggcacttccccaaccacctccagcactgggacaccatccccttcggcttcttctcatcttttatctccatcctgttctcctccaacttttcatctggcccccaacactttcaatgtgggctgccgagaaagccagctgtgtaatctaaacctctctgattatccaccatgtgcccgaagcaacatggctgccttgcagagctacccagggctgagtgacagtggctacaacaggcttcagagtggcaccacttcagccactcagccctctgaaaccttcatgcctcagaggactccatccctgatctcaggaataccaactcctccctcgttgcctacagcaagatggaagcctacggtggccagctggggtcctttcccacttcccagtttcagtatgtcatgcaggcaggcaatgctgcctccagctcctcatcaccacacatgttcgggggcagccacatgcagcagagctcctacaatgccttctcccttcacaacccttacaacctgtatggatacaatttccccacttcccctaggctag

SEQ ID NO: 31134 - DNA, 2678 bp, Homo sapiens
gggagaaacagaactggacttgaagccatcatggagacatatgcattctggagacctcctgtgcgcacactcaccttcgaagacttcaccaccatgcagaagcagcaagcctcaaagaagacttctcaaggatacacagtgaatcagcactcctcagagacagatgccattgaattatacgagagaagagtctggctcatggaacgaagaggcagcacaggcacttccccaaccacctccagcactgggacaccatccccttcggcttcttctcatcttttatctccatcctgttctcctccaacttttcatctggcccccaacactttcaatgtgggctgccgagaaagccagctgtgtaatctaaacctctctgattatccaccatgtgcccgaagcaacatggctgccttgcagagctacccagggctgagtgacagtggctacaacaggcttcagagtggcaccacttcagccactcagccctctgaaaccttcatgcctcagaggactccatccctgatctcaggaataccaactcctccctcgttgcctggcaacagcaagatggaagcctacggtggccagctggggtcctttcccacttcccagtttcagtatgtcatgcaggcaggcaatgctgcctccagctcctcatcaccacacatgttcgggggcagccacatgcagcagagctcctacaatgccttctcccttcacaacccttacaacctgtatggatacaatttccccacttcccctaggctagctgcaagcccggaaaaactgagcgcctctcaaagcactttactctgttcttctccttccaacggggcctttggagagaggcagtacctgccgtcagggatggagcacagcatgcacatgattagcccttcacccaataaccaacaggcaaccaacacttgtgatggccggcagtatggggcagttccaggctcctcctcccagatgtccgtgcacatggtttaaaggccagtccaaacaccacggagcatttggcaatcaaggccccagagtctccgtggtcagatcctcctctttgggagtccagtgtctttgaaaaacaggaaccgtgttttttttttttttttttttctggccgaagacatatacccaagaacaagagatacctttaagccagtgaaggatacttgcgatagaatcatccgcaactcagtggccattcttctgccttcccagaccttagttttataaagcattgtctgttccagagtggcctttgaagagactgaataatcacttcgtcataatgttaagggagatgctagtgtgtggcagccatgaaaagttacacatacacacccacatacagacagacctacctatacatacgtgcacacacacatacatattcatacacaattcatacacatgcaatcatacatgcacactgactctgaactgggtgaactctgtggagggaggcccagaatgggtgctttcaccaagaatttgtctgtgtacaactctagatggagtgggccagcagtagctgccagtctttctcccctgcagcttcctctgcttctggaatgaaccatgtatcctggagaccctcccaatggatgagagtggaaagacatcagtacaactggacttggcttccggaaaaagattgcttttgaactttggctctcttcacttgtatgctatcattgatattcccagtggtgcccgtggaaagagggagaaagagaagctgaacaggagaaagacaaacagaaagaatagagaacaggaacgaggtggagagcaagactgacagagaaagtgtgagcaatgatgagaattttaattcaccaaggagacgtgtttttggtttgtccccccaaaccccgcccgccccactacaggttatggaaagaatcatggcattactgaggagtaaacctctctggcacactgagcatggtcagggcattggtcagagggacagagcaaggaatgcatcctgagcccacagctttgaccactgtgatccagaagagaggtgcactacgtgggaagtgctgattccacagcatgcagcctggtaggggaaggaaaataaaagggtgtgaagaaggaatagttttataatctcggaagatgataccaagagcagaggcaacaaatagaggcctggcctccaggtgccggatccagacacctgacctagaatgcctgcccgctatccctgtggcaggaaatatcccctcatgtcccagggaattgcagatgggtcttctatacccttctacctgcccttagatctccatttttatcaaatagtacattgcattttgaagttttgggttttgtccttcatctttccctttcccttcaaatcttttaatggtaagaaagcaagtgaagcttggtgcaagctaaaatttttaaatggtgtggaaatgcaaataataccaagtaaaataatacagatattattaaagtttctggttttgaggtgttgtagataaatgtatttatgtgcctagtggggaatccaatattatgaatatgaaaaagggggcaataaaagggtatgtaaaatatgtatgaagaaaaggtgtacaaaaatttgcccttatgcacggaactctgtttctaagtgccaagcacagaaagccgctaaataaaatctttgcaattgt

SEQ ID NO: 31135 - DNA, 2822 bp, Homo sapiens
tagaagcaggcaagttgggtaacggctctcggcaaagttcgagaagtgcctatggccatgagtgagctgggcactcggaagcccagcgatggcactgtttctcatctgctcaatgtggtggagagtgagcttcaggcagggagggaaaaaggcgaccctacggagaagcaacttcagatcatcctggaggatgcacctctctggcagagattcaaggaagtcactaatgagatgattgtgaccaagaatggcagacggatgtttccagtcctaaagattagtgtcacagggttggaccccaatgccatgtactccctcctgctggactttgtccctacggacagtcaccgctggaagtacgtcaacggggaatgggtgcccgctggcaagccagaggtctccagccacagctgcgtctacattcacccggactcccccaactttggggcccactggatgaaagctcccatctccttcagcaaagtgaagctgaccaacaagctcaatggaggcgggcagataatgttgaattctctgcataaatatgaaccccaggttcacatagtgcgtgttggaagtgcccatcgaatggtaacaaactgctccttccctgaaacccagttcatagccgtgactgcctatcagaatgaggagataacggctctcaaaatcaagtacaatccttttgccaaagccttcttggatgccaaggaaagaaatcacctaagagacgtaccggaggctatctctgagagccagcatgtgacctattctcacttgggaggctggatcttttccaatccagatggagtgtgcacagcaggaaactccaattaccagtatgccgctcctctgcctctgcctgctccccacacccaccatggctgtgagcactattcgggtctccgaggacaccggcaggctccctacccttctgcgtacatgcacagaaaccattctccctcagtgaatttgatagaaagctcaagcaataatctgcaagttttctcgggacctgacagctggacttccttatcctccacaccccatgccagcatcctgtctgtaccccacaccaacggaccaatcaatccagggcccagcccctacccgtgcctgtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctttgcacagcgatccttccatgtgtagagtgcttagaaaccccatcaactgatctagtgagtcagactgtggaatctcccttcccactagctggaggtggaggtgggttattacagaagtcatactgggagagggttcagtttggatgatgctagttagatcatttgcatctctccaccattttcttctgcactcccattttctctgcagcttattcttgccatgcttaggtgacagaagtttgttaagtaccatccttgtgccctgcctcttattctcaaatcgttctggaaagcctcacttccttttctgtggagaaggtgcaaagctgttaaatgagctcagagtttacctagctaaggccactgcttcctgctttgtgaagcctggaaagtatgtgtggccacagggctcaggttcacacttctgctttgagaccaggatggggtgtaagccatagagtaaggttaacaaaaagaataaagctaatcatgtattacaaacagcagtgtgcccagacttgtggaaatgaagtcatgtcactcctctgctcagaaaccttcaatggttcaccattaccagtggaatgaagtcaattctcctcactataactgggtgtggtagtttaagcctataatctcagcccttttggaggccaaggtaagaggatcgcttgaggtcaggagttcgagaccagcttgtgcaacaaagtgagagcctgtctctacaaaaaatagtcatgcacacaaaattagctgggcatggtggcctgtgcctatagtcccaactacttagaggaggatcgcttgatctcaggaggttgaggctgcagtgaattatgattgtggcattgcactccagcctgggtggtagatcaaggctttgtttcatttgaaaaaaaagaaagaaagaaagaaagaaagaaatcctactacgagcgatcacaccatctggcctgaaaccacttccccagcttaggtccctctgttatcctgttggcctcctatgtattggtcaaggcaggcatctctgttctctgaacattcattgcactttcccacctctataccttgcctgtgccttagtgtcctcttttttccagttcacctgtgcgaatccgacccacctcccagagcctggctgaaacgtcactccctgcatccaacatctgatctgctgagatatgtctgatctatctctgctcgctgttctcccgttgtttttgcctctgccatagagctcacctcattttgccttgtatttttgttacctgtgagtgtgtctctccctattagactgtaagcctctcgagggtgaggcctagccttcttgtctttgtaacccacagcagctggtactgtgccttgcctattgtaggtgcccaataaacatttgctgaactgaa

SEQ ID NO: 31136 - DNA, 2631 bp, Homo sapiens
tagaagcaggcaagttgggtaacggctctcggcaaagttcgagaagtgcctatggccatgagtgagctgggcactcggaagcccagcgatggcactgtttctcatctgctcaatgtggtggagagtgagcttcaggcagggagggaaaaaggcgaccctacggagaagcaacttcagatcatcctggaggatgcacctctctggcagagattcaaggaagtcactaatgagatgattgtgaccaagaatggcagacggatgtttccagtcctaaagattagtgtcacagggttggaccccaatgccatgtactccctcctgctggactttgtccctacggacagtcaccgctggaagtacgtcaacggggaatgggtgcccgctggcaagccagaggtctccagccacagctgcgtctacattcacccggactcccccaactttggggcccactggatgaaagctcccatctccttcagcaaagtgaagctgaccaacaagctcaatggaggcgggcagataatgttgaattctctgcataaatatgaaccccaggttcacatagtgcgtgttggaagtgcccatcgaatggtaacaaactgctccttccctgaaacccagttcatagccgtgactgcctatcagaatgaggagataacggctctcaaaatcaagtacaatccttttgccaaagccttcttggatgccaaggaaagaaatcacctaagagacgtaccggaggctatctctgagagccagcatgtgacctattctcacttgaatttgatagaaagctcaagcaataatctgcaagttttctcgggacctgacagctggacttccttatcctccacaccccatgccagcatcctgtctgtaccccacaccaacggaccaatcaatccagggcccagcccctacccgtgcctgtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctttgcacagcgatccttccatgtgtagagtgcttagaaaccccatcaactgatctagtgagtcagactgtggaatctcccttcccactagctggaggtggaggtgggttattacagaagtcatactgggagagggttcagtttggatgatgctagttagatcatttgcatctctccaccattttcttctgcactcccattttctctgcagcttattcttgccatgcttaggtgacagaagtttgttaagtaccatccttgtgccctgcctcttattctcaaatcgttctggaaagcctcacttccttttctgtggagaaggtgcaaagctgttaaatgagctcagagtttacctagctaaggccactgcttcctgctttgtgaagcctggaaagtatgtgtggccacagggctcaggttcacacttctgctttgagaccaggatggggtgtaagccatagagtaaggttaacaaaaagaataaagctaatcatgtattacaaacagcagtgtgcccagacttgtggaaatgaagtcatgtcactcctctgctcagaaaccttcaatggttcaccattaccagtggaatgaagtcaattctcctcactataactgggtgtggtagtttaagcctataatctcagcccttttggaggccaaggtaagaggatcgcttgaggtcaggagttcgagaccagcttgtgcaacaaagtgagagcctgtctctacaaaaaatagtcatgcacacaaaattagctgggcatggtggcctgtgcctatagtcccaactacttagaggaggatcgcttgatctcaggaggttgaggctgcagtgaattatgattgtggcattgcactccagcctgggtggtagatcaaggctttgtttcatttgaaaaaaaagaaagaaagaaagaaagaaagaaatcctactacgagcgatcacaccatctggcctgaaaccacttccccagcttaggtccctctgttatcctgttggcctcctatgtattggtcaaggcaggcatctctgttctctgaacattcattgcactttcccacctctataccttgcctgtgccttagtgtcctcttttttccagttcacctgtgcgaatccgacccacctcccagagcctggctgaaacgtcactccctgcatccaacatctgatctgctgagatatgtctgatctatctctgctcgctgttctcccgttgtttttgcctctgccatagagctcacctcattttgccttgtatttttgttacctgtgagtgtgtctctccctattagactgtaagcctctcgagggtgaggcctagccttcttgtctttgtaacccacagcagctggtactgtgccttgcctattgtaggtgcccaataaacatttgctgaactg

SEQ ID NO: 31137 - DNA, 2377 bp, Homo sapiens
acggatgtttccagtcctaaagattagtgtcacagggttggaccccaatgccatgtactccctcctgctggactttgtccctacggacagtcaccgctggaagtacgtcaacggggaatgggtgcccgctggcaagccagaggtctccagccacagctgcgtctacattcacccggactcccccaactttggggcccactggatgaaagctcccatctccttcagcaaagtgaagctgaccaacaagctcaatggaggcgggcagataatgttgaattctctgcataaatatgaaccccaggttcacatagtgcgtgttggaagtgcccatcgaatggtaacaaactgctccttccctgaaacccagttcatagccgtgactgcctatcagaatgaggagataacggctctcaaaatcaagtacaatccttttgccaaagccttcttggatgccaaggaaagaaatcacctaagagacgtaccggaggctatctctgagagccagcatgtgacctattctcacttgaatttgatagaaagctcaagcaataatctgcaagttttctcgggacctgacagctggacttccttatcctccacaccccatgccagcatcctgtctgtaccccacaccaacggaccaatcaatccagggcccagcccctacccgtgcctgtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctttgcacagcgatccttccatgtgtagagtgcttagaaaccccatcaactgatctagtgagtcagactgtggaatctcccttcccactagctggaggtggaggtgggttattacagaagtcatactgggagagggttcagtttggatgatgctagttagatcatttgcatctctccaccattttcttctgcactcccattttctctgcagcttattcttgccatgcttaggtgacagaagtttgttaagtaccatccttgtgccctgcctcttattctcaaatcgttctggaaagcctcacttccttttctgtggagaaggtgcaaagctgttaaatgagctcagagtttacctagctaaggccactgcttcctgctttgtgaagcctggaaagtatgtgtggccacagggctcaggttcacacttctgctttgagaccaggatggggtgtaagccatagagtaaggttaacaaaaagaataaagctaatcatgtattacaaacagcagtgtgcccagacttgtggaaatgaagtcatgtcactcctctgctcagaaaccttcaatggttcaccattaccagtggaatgaagtcaattctcctcactataactgggtgtggtagtttaagcctataatctcagcccttttggaggccaaggtaagaggatcgcttgaggtcaggagttcgagaccagcttgtgcaacaaagtgagagcctgtctctacaaaaaatagtcatgcacacaaaattagctgggcatggtggcctgtgcctatagtcccaactacttagaggaggatcgcttgatctcaggaggttgaggctgcagtgaattatgattgtggcattgcactccagcctgggtggtagatcaaggctttgtttcatttgaaaaaaaagaaagaaagaaagaaagaaagaaatcctactacgagcgatcacaccatctggcctgaaaccacttccccagcttaggtccctctgttatcctgttggcctcctatgtattggtcaaggcaggcatctctgttctctgaacattcattgcactttcccacctctataccttgcctgtgccttagtgtcctcttttttccagttcacctgtgcgaatccgacccacctcccagagcctggctgaaacgtcactccctgcatccaacatctgatctgctgagatatgtctgatctatctctgctcgctgttctcccgttgtttttgcctctgccatagagctcacctcattttgccttgtatttttgttacctgtgagtgtgtctctccctattagactgtaagcctctcgagggtgaggcctagccttcttgtctttgtaacccacagcagctggtactgtgccttgcctattgtaggtgcccaataaacatttgctgaactg

SEQ ID NO: 31138 - DNA, 1757 bp, Homo sapiens
aaaagagagggaattaaactggttttacagaagacaaagggttctgtttgcccatgtgtatcctacttttactaacacttcttgtctttgtaaatgcaagataacggctctcaaaatcaagtacaatccttttgccaaagccttcttggatgccaaggaaagaaatcacctaagagacgtaccggaggctatctctgagagccagcatgtgacctattctcacttgggaggctggatcttttccaatccagatggagtgtgcacagcaggaaactccaattaccagtatgccgctcctctgcctctgcctgctccccacacccaccatggctgtgagcactattcgggtctccgaggacaccggcaggctccctacccttctgcgtacatgcacagaaaccattctccctcagtgaatttgatagaaagctcaagcaataatctgcaagttttctcgggacctgacagctggacttccttatcctccacaccccatgccagcatcctgtctgtaccccacaccaacggaccaatcaatccagggcccagcccctacccgtgcctgtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctttgcacagcgatccttccatgtgtagagtgcttagaaaccccatcaactgatctagtgagtcagactgtggaatctcccttcccactagctggaggtggaggtgggttattacagaagtcatactgggagagggttcagtttggatgatgctagttagatcatttgcatctctccaccattttcttctgcactcccattttctctgcagcttattcttgccatgcttaggtgacagaagtttgttaagtaccatccttgtgccctgcctcttattctcaaatcgttctggaaagcctcacttccttttctgtggagaaggtgcaaagctgttaaatgagctcagagtttacctagctaaggccactgcttcctgctttgtgaagcctggaaagtatgtgtggccacagggctcaggttcacacttctgctttgagaccaggatggggtgtaagccatagagtaaggttaacaaaaagaataaagctaatcatgtattacaaacagcagtgtgcccagacttgtggaaatgaagtcatgtcactcctctgctcagaaaccttcaatggttcaccattaccagtggaatgaagtcaattctcctcactataactgggtgtggtagtttaagcctataatctcagcccttttggaggccaaggtaagaggatcgcttgaggtcaggagttcgagaccagcttgtgcaacaaagtgagagcctgtctctacaaaaaatagtcatgcacacaaaattagctgggcatggtggcctgtgcctatagtcccaactacttagaggaggatcgcttgatctcaggaggttgaggctgcagtgaattatgattgtggcattgcactccagcctgggtggtagatcaaggctttgtttcatttg

SEQ ID NO: 31139 - DNA, 1871 bp, Homo sapiens
ggatcgccgccgccagcaaattaaggcgcagggcagcgagcgccagggctcactgtccgtagttccgcgccgcgctccccacgccagcgtcctagcagccgcgctcggctggtggccacctcagcctgggacatcccggctgtccccagccccagagggaggaaggacgcggaggggatgctccaggaccccaggactttgtgcagttgatgctcgtttccgccttcgggctgtgcagactgtcgtcctgccgagcgccccggggcgtgcgcacccgccgtagtgctcggtgggccctctcctctccggctgccttcgaagtctctgcggctctggggctttgcggtggggaatagaggccagtgtgcagctctggagtcgttggagctgacacttctggagtccctggccccgctgtgactgctctcggaaactttgagctgtgtttcgggtctttgtctcccttggggaatctggacggcagttcggacgaccccgtccctggccaggaccgcgtgctggggaccatggagttcacggcgtcccccaagccccaactctcctctcgggccaacgccttctccattgccgcgctcatgtcgagcggcggctctaaggagaaggaggcgacggagaacacaatcaaacccctggagcaatttgtggagaagtcgtcctgtgcccagcccctgggtgagctgaccagcctggatgctcatggggagtttggtggaggcagtggcagcagcccgtcctcctcctctctgtgcactgagccactgatccccaccacccccatcatccccagtgaggaaatggccaaaattgcctgcagcctggagaccaaggagctttgggacaaattccatgagctgggcaccgagatgatcatcaccaagtcgggcaggaggatgtttccaaccatccgggtgtccttttcgggggtggatcctgaggccaagtacatagtcctgatggacatcgtccctgtggacaacaagaggtaccgctacgcctaccaccggtcctcctggctggtggctggcaaggccgacccgccgttgccagccaggctctatgtgcatccagattctccttttaccggtgagcaactactcaaacagatggtgtcttttgaaaaggtgaaactcaccaacaatgaactggatcaacatggccatataattttgaactcaatgcataagtaccagccaagggtgcacatcattaagaagaaagaccacacagcctcattgctcaacctgaagtctgaagaatttagaactttcatctttccagaaacagtttttacggcagtcactgcctaccagaatcaactgataacgaagctgaaaatagatagcaatccttttgccaaaggattccgggattcctccaggctcactgacattgagagggaaagtgtggagagcctgattcaaaagcattcctatgcacgctcacccatccgtacctacggaggagaagaagatgtcttgggggatgagagtcagacaaccccaaatcgagggtcagcctttacaacatctgataatttgtctctcagctcctgggtatcatcttcttccagttttcctgggtttcagcacccacagtccctgactgctcttggcaccagcacagcatccatagcaacacccattcctcaccccatccagggttctctgccaccatatagccgactgggaatgcctctgacaccatcggccattgccagctccatgcaagggagtggccccacattcccttcattccacatgccgcgataccatcactattttcagcaggggccctatgctgccattcaaggactacgccattcctctgctgtgatgacgccatttgtatga

SEQ ID NO: 31140 - DNA, 2572 bp, Homo sapiens
cggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggcggatgttcccattcctgtcatttactgtggccgggctggagcccaccagccactacaggatgtttgtggacgtggtcttggtggaccagcaccactggcggtaccagagcggcaagtgggtgcagtgtggaaaggccgagggcagcatgccaggaaaccgcctgtacgtccacccggactcccccaacacaggagcgcactggatgcgccaggaagtttcatttgggaaactaaagctcacaaacaacaagggggcgtccaacaatgtgacccagatgattgtgctccagtccctccataagtaccagccccggctgcatatcgttgaggtgaacgacggagagccagaggcagcctgcaacgcttccaacacgcatatctttactttccaagaaacccagttcattgccgtgactgcctaccagaatgccgagattactcagctgaaaattgataataacccctttgccaaaggattccgggagaactttgagtccatgtacacatctgttgacaccagcatcccctccccgcctggacccaactgtcaattccttgggggagatcactactctcctctcctacccaaccagtatcctgttcccagccgcttctaccccgaccttcctggccaggcgaaggatgtggttccccaggcttactggctgggggccccccgggaccacagctatgaggctgagtttcgagcagtcagcatgaagcctgcattcttgccctctgcccctgggcccaccatgtcctactaccgaggccaggaggtcctggcacctggagctggctggcctgtggcaccccagtaccctcccaagatgggcccggccagctggttccgccctatgcggactctgcccatggaacccggccctggaggctcagagggacggggaccagaggaccagggtccccccttggtgtggactgagattgcccccatccggccggaatccagtgattcaggactgggcgaaggagactctaagaggaggcgcgtgtccccctatccttccagtggtgacagctcctcccctgctggggccccttctccttttgataaggaagctgaaggacagttttataactattttcccaactgagcagatgacatgatgaaaggaacagaaacagtgttattaggttggaggacaccgactaatttgggaaacggatgaaggactgagaaggcccccgctccctctggcccttctctgtttagtagttggttggggaagtggggctcaagaaggattttggggttcaccagatgcttcctggcccacgatgaaacctgagaggggtgtccccttgccccatcctctgccctaactacagtcgtttacctggtgctgcgtcttgcttttggtttccagctggagaaaagaagacaagaaagtcttgggcatgaaggagctttttgcatctagtgggtgggaggggtcaggtgtgggacatgggagcaggagactccactttcttcctttgtacagtaactttcaaccttttcgttggcatgtgtgttaatccctgatccaaaaagaacaaatacacgtatgttataaccatcagcccgccagggtcagggaaaggactcacctgactttggacagctggcctgggctccccctgctcaaacacagtggggatcagagaaaaggggctggaaaggggggaatggcccacatctcaagaagcaagatattgtttgtggtggttgtgtgtgggtgtgtgttttttctttttctttctttttattttttttgaatgggggaggctatttattgtactgagagtggtgtctggatatattccttttgtcttcatcactttctgaaaataaacataaaactgtt

SEQ ID NO: 31141 - DNA, 2100 bp, Homo sapiens
ctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggttcggttctgcccaagctgttcacaagggtcacacacattaggcacttaatttaccgctctggcggatgttcccctctgttcgggtcaaggtgaaagggttggatccagggaagcagtaccatgtggccatcgatgtggtgccggtggattccaaacgctataggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacagattacgaaactaaaaatagaaagaaatccttttgctaaaggatttagagatactggaagaaacaggggtgtattggatgggcttttagagacctacccatggaggccttctttcactctcgattttaaaacctttggcgcagacacacaaagtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgatactccaccagtgaaaattgatgctaagtgatgggattttcaattatactgaagctagttcaccacgttaactgcattttacacattgacaatgacaaaaagaagatggatgtaattctcatgaaagcagtgaagcaatttcagttttaaaaatgaagatcggctttcatgtaattatctagtagttgtagaagaaaatttaattatttgtttgcctcatgcctttatactttgctgttgaagaaactactaatctcaatttaagatacaaataaggacacaaactttcaagtattatattttatttatctttgtagcctaaagaccatttaatcttgaaggaacacaaagatcaaatgaaaagtaaaacactctaaataaatttgcttttattttc

SEQ ID NO: 31142 - DNA, 2249 bp, Homo sapiens
gcaaagaatcccttcaccccctccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttgaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggcggatgttcccctctgttcgggtcaaggtgaaagggttggatccagggaagcagtaccatgtggccatcgatgtggtgccggtggattccaaacgctataggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacagattacgaaactaaaaatagaaagaaatccttttgctaaaggatttagagatactggaagaaacaggggtgtattggatgggcttttagagacctacccatggaggccttctttcactctcgattttaaaacctttggcgcagacacacaaagtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgatactccaccagtgaaaattgatgctaagtgatgggattttcaattatactgaagctagttcaccacgttaactgcattttacacattgacaatgacaaaaagaagatggatgtaattctcatgaaagcagtgaagcaatttcagttttaaaaatgaagatcggctttcatgtaattatctagtagttgtagaagaaaatttaattatttgtttgcctcatgcctttatactttgctgttgaagaaactactaatctcaatttaagatacaaataaggacacaaactttcaagtattatattttatttatctttgtagcctaaagaccatttaatcttgaaggaacacaaagatcaaatgaaaagtaaaacactctaaataaatttgcttttattttc

SEQ ID NO: 31143 - DNA, 1959 bp, Homo sapiens
cttctctgggctcttgagaagagctgctgcaggcatttgcagagtgaatgagctctgactgagacttgacttcagaaccactgggctggcctggcctcttgacacagcaacacactgcttcttgccttccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttgaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggcggatgttcccctctgttcgggtcaaggtgaaagggttggatccagggaagcagtaccatgtggccatcgatgtggtgccggtggattccaaacgctataggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacagattacgaaactaaaaatagaaagaaatccttttgctaaaggatttagagatactggaagaaacaggggtgtattggatgggcttttagagacctacccatggaggccttctttcactctcgattttaaaacctttggcgcagacacacaaagtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgat

SEQ ID NO: 31144 - DNA, 2351 bp, Homo sapiens
cttctctgggctcttgagaagagctgctgcaggcatttgcagagtgaatgagctctgactgagacttgacttcagaaccactgggctggcctggcctcttgacacagcaacacactgcttcttgccttccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttgaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcggatgttcccctctgttcgggtcaaggtgaaagggttggatccagggaagcagtaccatgtggccatcgatgtggtgccggtggattccaaacgctataggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacagattacgaaactaaaaatagaaagaaatccttttgctaaaggatttagagatactggaagaaacaggggtgtattggatgggcttttagagacctacccatggaggccttctttcactctcgattttaaaacctttggcgcagacacacaaagtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgatactccaccagtgaaaattgatgctaagtgatgggattttcaattatactgaagctagttcaccacgttaactgcattttacacattgacaatgacaaaaagaagatggatgtaattctcatgaaagcagtgaagcaatttcagttttaaaaatgaagatcggctttcatgtaattatctagtagttgtagaagaaaatttaattatttgtttgcctcatgcctttatactttgctgttgaagaaactactaatctcaatttaagatacaaataaggacacaaactttcaagtattatattttatttatctttgtagcctaaagaccatttaatcttgaaggaacacaaagatcaaatgaaaagtaaaacactctaaataaatttgcttttattttc

SEQ ID NO: 31145 - DNA, 4208 bp, Homo sapiens
gcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactttggccttcccaagtgatcacgctacgtggcaggggaattatagttttggtactcagactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtc

SEQ ID NO: 31146 - DNA, 4723 bp, Homo sapiens
gaattctagaggcggcggagggtggcgaggagctctcgctttctctcgctccctccctctccgactccgtctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtct

SEQ ID NO: 31147 - DNA, 2767 bp, Homo sapiens
gaattctagaggcggcggagggtggcgaggagctctcgctttctctcgctccctccctctccgactccgtctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactttggccttcccaagtgatcacgctacgtggcaggggaattatagttttggtactcagactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcggcagcctccagctcggtgcaccgccaccccttcctcaatctgaacaccatgcgcccgcggctgcgctacagcccctactccatcccggtgccggtcccggacggcagcagtctgctcaccaccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtag

SEQ ID NO: 31148 - DNA, 2470 bp, Homo sapiens
tgtggacctgggcgagtgactcgttgtgtgctgtgcccgcaggagatgctgcaggataagggcctgtccgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcagaccatcgagaacatcaaggtggggctgcatgagaaggagctctggaagaagttccacgaggcgggcaccgagatgatcatcactaaggctggcaggaggatgttccccagctacaaggtaaaagtcacaggcatgaaccccaagaccaagtatatcctgctgattgacattgtccctgccgatgaccatcgctacaagttctgtgacaacaaatggatggtggcagggaaggctgagccagccatgccaggaaggctgtatgtccacccggattctcctgccacaggagcccactggatgcggcagctggtctccttccagaagctgaagctgacaaacaaccacctggacccctttggccatatcatcctcaactctatgcacaagtaccagccgcggctccacatcgttaaggctgatgagaacaatgctttcggctccaaaaacactgctttctgcacccacgtgttcccagagacctccttcatctctgtgacctcctaccagaatcacaagatcacccagctgaaaattgagaacaacccttttgccaagggattccggggcagtgatgacagtgacctgcgtgtggcccgactgcagagcaaagaataccccgtgatttccaaaagcatcatgaggcagaggctcatctccccccagctctcagccacaccggacgtgggccccctgctcggcacccaccaggcactccagcactaccagcacgagaacggggcacactcacagctcgcggagccgcaggacctgcccctcagcacctttcccacccagagggactcaagcctcttctatcactgcctgaaaagacgagacggtacccgccacctggacttaccttgcaagcgatcctatctggaagccccctcttcggtgggggaggatcactatttccgttccccccctccctacgaccagcaaatgctgagcccctcctactgcagtgaggtgacccccagagaagcatgtatgtactcaggttcagggcccgagattgccggggtgtctggggtggacgacctgcccccacctccgctgagctgtaacatgtggacttcagtgtcgccgtacaccagctatagcgtgcagacgatggagactgtgccgtaccagcccttccccacgcacttcaccgccaccaccatgatgccgcggctgcccaccctctccgctcagagctcccagccaccaggaaatgcccactttagtgtctacaatcagctctcccagtctcaggtccgagagcgggggcccagcgcctcattcccaagagagcgcggcctcccccaagggtgtgagaggaagccaccctcgccacatctaaatgctgccaatgagtttctctactctcaaaccttctccttgtcccgagaatcttccttacagtaccattcaggaatggggactgtggagaactggactgacggatgactctcacgtctcctccatagccccgggaccgtgttgctccagtattaacctctgtgggtggcctgcactctaccaagaaacacaggaaggtattccagtgtgtgtgtgtgtgtgtgtgtgtgtgtgtgtgtgtgtgtatacacgagcatgtatgtatttggagagcatccatcttctgacatacaactgaggtcatgacaaggaaaaaaaacaccacatttatctaagaagtgattttggctgcaggacctgggtctattgttatctgacatctcttgacatgcccgtgggtgggatgggagtggagggttcatatgagttattgagagggttttataatggttgatttactcaggggccaggtggggagttctctcccatggggaaagattctcactgctggggtgggaagattctcgctgctggggtgtgaggactctgtgcacaccttagagttcctggccttctctttgcaaggggagctgagaatctggttttggtagcaggaggcccactcctttgacttctggagagtctgtgagactgcctgagaggtgggctcagctaagccacaatgtgtactttgatagtacagctggctgctcagtgagtggcctagacattgatgactggagctctgaggtctgagggatgacgttcggaaagggtcatgggctaaatgtcacctgaggggtatttttaaagggtttttttttcccttcaagaggagggaaaatgcaaccagtagcatctctgtcatcattcagattttgtaataaagtacaga

SEQ ID NO: 31149 - DNA, 3396 bp, Homo sapiens
ctccagagccgggatgtgtccagccccgagggcacggcaggcagctggaccctgacccagcggcgcggagtcggagccccggccgtcccgcgctcctcggacccgaacctgcaggggacctcgggccgctggcgcctccgcatgcggcaccgcaattagggagatgctgcaggataagggcctgtccgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcagaccatcgagaacatcaaggtggggctgcatgagaaggagctctggaagaagttccacgaggcgggcaccgagatgatcatcactaaggctggcaggaggatgttccccagctacaaggtaaaagtcacaggcatgaaccccaagaccaagtatatcctgctgattgacattgtccctgccgatgaccatcgctacaagttctgtgacaacaaatggatggtggcagggaaggctgagccagccatgccaggaaggctgtatgtccacccggattctcctgccacaggagcccactggatgcggcagctggtctccttccagaagctgaagctgacaaacaaccacctggacccctttggccatatcatcctcaactctatgcacaagtaccagccgcggctccacatcgttaaggctgatgagaacaatgctttcggctccaaaaacactgctttctgcacccacgtgttcccagagacctccttcatctctgtgacctcctaccagaatcacaagatcacccagctgaaaattgagaacaacccttttgccaagggattccggggcagtgatgacagtgacctgcgtgtggcccgactgcagagcaaagaataccccgtgatttccaaaagcatcatgaggcagaggctcatctccccccagctctcagccacaccggacgtgggccccctgctcggcacccaccaggcactccagcactaccagcacgagaacggggcacactcacagctcgcggagccgcaggacctgcccctcagcacctttcccacccagagggactcaagcctcttctatcactgcctgaaaagacgagcagacggtacccgccacctggacttaccttgcaagcgatcctatctggaagccccctcttcggtgggggaggatcactatttccgttccccccctccctacgaccagcaaatgctgagcccctcctactgcagtgaggtgacccccagagaagcatgtatgtactcaggttcagggcccgagattgccggggtgtctggggtggacgacctgcccccacctccgctgagctgtaacatgtggacttcagtgtcgccgtacaccagctatagcgtgcagacgatggagactgtgccgtaccagcccttccccacgcacttcaccgccaccaccatgatgccgcggctgcccaccctctccgctcagagctcccagccaccaggaaatgcccactttagtgtctacaatcagctctcccagtctcaggtccgagagcgggggcccagcgcctcattcccaagagagcgcggcctcccccaagggtgtgagaggaagccaccctcgccacatctaaatgctgccaatgagtttctctactctcaaaccttctccttgtcccgagaatcttccttacagtaccattcaggaatggggactgtggagaactggactgacggatgactctcacgtctcctccatagccccgggaccgtgttgctccagtattaacctctgtgggtggcctgcactctaccaagaaacacaggaaggtattccagtgtgtgtgtgtgtgtgtgtgtgtgtgtgtgtgtgtgtgtatacacgagcatgtatgtatttggagagcatccatcttctgacatacaactgaggtcatgacaaggaaaaaaaacaccacatttatctaagaagtgattttggctgcaggacctgggtctattgttatctgacatctcttgacatgcccgtgggtgggatgggagtggagggttcatatgagttattgagagggttttataatggttgatttactcaggggccaggtggggagttctctcccatggggaaagattctcactgctggggtgggaagattctcgctgctggggtgtgaggactctgtgcacaccttagagttcctggccttctctttgcaaggggagctgagaatctggttttggtagcaggaggcccactcctttgacttctggagagtctgtgagactgcctgagaggtgggctcagctaagccacaatgtgtactttgatagtacagctggctgctcagtgagtggcctagacattgatgactggagctctgaggtctgagggatgacgttcggaaagggtcatgggctaaatgtcacctgaggggtatttttaaagggtttttttttcccttcaagaggagggaaaatgcaaccagtagcatctctgtcatcattcagattttgtaataaagtacagagcccttccccctaggtccccaacatacagtctctcactctggtgtgtggagagtcagcctcccaggcaccataccatctgcatcctatgatgatgggcaattatgaaacacgcctcagctggcatcatccccaggaggccacactggagctgatgtctggcatctccagggcctgttctgctctcagaaaatctacgcttctggagcgagaaaggccaacagaaataaagatagttgaaaaaaatttgtttcttccagtaaattcagccggtgagctcagaggagcaaagagaattctccagtgtggcgctcacaaagtcctcagccctgcgttttagcattgaataccaccaggccatcagtgtggctggggtgaactctccatcaaacttgggaaatcactaaactctttgcatgctgaatagctatttatatattatataaataaataaatatatatattatatatcgctctctctcacaaatgcaggccacatgtcaaattcagctttgctttctacaaatgaatgaacttaataaaaataaacgttggagggggtatttggaaagacatctatttaaatttttattacatgtttgatattaaaaactaagaatggtttagataaaacatataaataaatatatatatatatatatatatatataaacacacacacactacagataaggcttttttagaaaacacattagctaacaggtgatatggaacttcaagtgttttgttatatagcatggatgttttattttgcatatcggaacataaagccattttacaactgtg

SEQ ID NO: 31150 - DNA, 3825 bp, Homo sapiens
catgccttatgcaagagacctcagtcccccggaacaactcgatttccttccaatagaggtctgaggtggactcccacctcccttcgtgaagagttccctcctctcccccttcctaagaaagtcgatcttggctctatttgtgtcttatgttcatcaccctcattcctccggagaaagccgggttggtttatgtctttatttattcccggggccaagacgtccggaacctgtggctgcgcagacccggcactgataggcgaagacggagagaaatttacctcccgccgctgccccccagccaaacgtgacagcgcgcgggccggttgcgtgactcgtgacgtctccaagtcctataggtgcagcggctggtgagatagtcgctatcgcctggttgcctctttattttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggagagcagaaccttgcgcgggcacagggccctgggcgcaccatggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacggacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttccctagtgcgtagttggagtctgtccctgtcttggtgttaatgttgacattgttatataataaatgataatatatttttttctttcaattttcttaatgggacccagtcccttatttggggggaggtctgaggcaagtatatttcaaaatatgtacttgcgggattcccttcaagtaaaccatccctgaaacctaaattcacgtttccccttgactaagaaaagcacctacctctgccatgtgatgtttctgaaaagcctctgtatgtccccatttgctttggttttgtcctgccttctccaatatcacgtgctcagttttgcctctacttacccatggagtcaggataacactgacgctccctggcatcctatcttattcagccctaccatcttgccagctctgtctttccagctgtctgtcgctaaaacgtggcctatagcttcccttccggaaagcttgctttgaaaaacttaaaaagcccccgtttacatgtaggcaggactgtgataacagtgcaagctctgtgttgacaagagttgtggacaaaaagccaaaataaatattcttcctgattaaaaaaattttttttgaaaaaaacaaggccagccccaaccttccaaacctccatcaccaacaacccaaactggatgtcaagcaaaatgcacaattcctacagaagaggcaagacacagtcaccaatgatatctcgccaaagaaaccacgcccacaccaatgccaacacaaaactgtgtttactgaaagccgaaaacagtattaaaaaaagtgtgtaagtaaagtgttatggtagggttcttcagatgtaatattttactggtactatttatttataaataggaattctaattaagtaataacatgaaatgaaacccagcataggagctggccaagagcttttaattttattgatactcaaaaccaagtttgtgtttttttgtttttttttgtttttttcctctttcgaatgtgctttgctttttttgattaaaaagaattttttttttccttttttataaacagaccctaataaagagaacagggtaagatgtgaggctgagtgtgtttaagtacgtgagagagtgtgagtgtgtttgtaagtgagtgtccctatgcgattatgtctctttacgttgctaaggggggagggtgaggattaagtactcgtgccttatatttgtgtgccaattaatgcctaataaataccatgtgcttaaacaagt

SEQ ID NO: 31151 - DNA, 3585 bp, Homo sapiens
gaggtctgaggtggactcccacctcccttcgtgaagagttccctcctctcccccttcctaagaaagtcgatcttggctctatttgtgtcttatgttcatcaccctcattcctccggagaaagccgggttggtttatgtctttatttattcccggggccaagacgtccggaacctgtggctgcgcagacccggcactgataggcgaagacggagagaaatttacctcccgccgctgccccccagccaaacgtgacagcgcgcgggccggttgcgtgactcgtgacgtctccaagtcctataggtgcagcggctggtgagatagtcgctatcgcctggttgcctctttattttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacggacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttccctagtgcgtagttggagtctgtccctgtcttggtgttaatgttgacattgttatataataaatgataatatatttttttctttcaattttcttaatgggacccagtcccttatttggggggaggtctgaggcaagtatatttcaaaatatgtacttgcgggattcccttcaagtaaaccatccctgaaacctaaattcacgtttccccttgactaagaaaagcacctacctctgccatgtgatgtttctgaaaagcctctgtatgtccccatttgctttggttttgtcctgccttctccaatatcacgtgctcagttttgcctctacttacccatggagtcaggataacactgacgctccctggcatcctatcttattcagccctaccatcttgccagctctgtctttccagctgtctgtcgctaaaacgtggcctatagcttcccttccggaaagcttgctttgaaaaacttaaaaagcccccgtttacatgtaggcaggactgtgataacagtgcaagctctgtgttgacaagagttgtggacaaaaagccaaaataaatattcttcctgattaaaaaaattttttttgaaaaaaacaaggccagccccaaccttccaaacctccatcaccaacaacccaaactggatgtcaagcaaaatgcacaattcctacagaagaggcaagacacagtcaccaatgatatctcgccaaagaaaccacgcccacaccaatgccaacacaaaactgtgtttactgaaagccgaaaacagtattaaaaaaagtgtgtaagtaaagtgttatggtagggttcttcagatgtaatattttactggtactatttatttataaataggaattctaattaagtaataacatgaaatgaaacccagcataggagctggccaagagcttttaattttattgatactcaaaaccaagtttgtgtttttttgtttttttttgtttttttcctctttcgaatgtgctttgctttttttgattaaaaagaattttttttttccttttttataaacagaccctaataaagagaacagggtaagatgtgaggctgagtgtgtttaagtacgtgagagagtgtgagtgtgtttgtaagtgagtgtccctatgcgattatgtctctttacgttgctaaggggggagggtgaggattaagtactcgtgccttatatttgtgtgccaattaatgcctaataaataccatgtgcttaaacaagt

SEQ ID NO: 31152 - DNA, 2203 bp, Homo sapiens
ttcagagagagagagagagggagagagagtgagagagactgactcttacctcgaatccgggaactttaatcctgaaagctgcgctcagaaaggacttcgaccattcactgggcttccaactttccctccctgggggtgtaaaggaggagcggggcactgagattatatggttgccggtgctcttggaggctattttgtgttctttggcgcttgccaactgggaagtatttagggagagcaagcgcacagcagaggaggtgtgtgttggaggtgggcagtcgccgcggaggctccagcggtaggtgcgccctagtaggcagcagtagccgctattctgggtaagcagtaaaccccgcataaaccccggagccaccatgcctgctcccccgcctcaccgccggcttccctgctaggagcagcagaggatgtggtgaatgcaccggcttcaccgaacgagagcagaaccttgcgcgggcacagggccctgggcgcaccatggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacggacaagatttttcatttcacccaatgttcacatctgcactcaaggtcgctggat

SEQ ID NO: 31153 - DNA, 1911 bp, Homo sapiens
attttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggagagcagaaccttgcgcgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcttcacaacagacatttcctagagaaagagagagagagaggagaaagagagagaaggagagagacagtagccaagagaaccccacggacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttccctagtgcgtagttggagtctgtccctgtcttggtgttaatgttgacattgttatataataaatgataatatatttttttctttcaattttcttaatgggacccagtcccttatttggggggaggtctgaggcaagtatatttcaaaatatgtacttgcgggatt

SEQ ID NO: 31154 - DNA, 1050 bp, Homo sapiens
atggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaaggtgagtgtgatcacccctggtcaatttgctttctttcttaccttttcctttccttgggttgggggtga

SEQ ID NO: 31155 - DNA, 1796 bp, Homo sapiens
tctcgcagcaccgggggccctaagcagcgagacctgaggccagacggaactacaacatgtaccatccacgagaattgtacccgtccctgggggccggctaccgcctggggcccgcccaacctggggccgactccagcttcccacccgccctagcggagggctaccgctaccccgaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacctgatcctgcactccatgcacaagtaccaaccccgcatacacctagttcgggcagcccagctctgcagccagcactgggggggcatggcctccttccgcttccccgagaccacattcatctccgtgacagcctaccagaacccacagatcacacaactgaagattgcagccaatccctttgccaaaggcttccgggagaacggcagaaactgtaagagggagcgagacgcccgtgtgaagaggaaactgcggggcccagagccagcagccacagaggcctatgggagcggagacacaccaggtggtccctgcgactccaccctgggtggagacattcgtgaatcagatccagaacaggccccagcccccggggaagccaccgctgccccggcacctctgtgtggtggccccagtgctgaggcctacctcctgcaccctgcggctttccatggggcccccagtcaccttcccaccaggagccccagcttcccggaggctccagactccgggcgctcagccccctactcggctgcatttctggagctgccgcacgggtcagggggctccgggtacccagcggctccaccggcggtaccctttgccccgcactttctccaagggggccccttccctctaccatacaccgcgcctgggggctatctggatgtgggctccaaacccatgtactgaaccactgctgggcccctctgcctccatcacaaacctcccgctcccttcccccagccctggagccccctcacctccaccggccccatcccccacaccaaatggccgccttgggcctgcccacccaccccctcaacttcacaccttgatttcactcccacccccctctggcttcaaagcctaaccaaggctgctgggagtccagctggggccggcttccccttcccggctctcacctccgtgtgaatggaaggggctctgcctggccaaatggggccacagaccagcatccccacttaccaggcctccccatgggctctggaggggctcaatccccacccccccacacacactggtgcaggccacaccagtctgttgttctgggaccagagtatttttgttaataaaactcaaaagccatccatgctcagg

SEQ ID NO: 31156 - DNA, 1835 bp, Homo sapiens
agctgtcggactcaccgggggccctaagcagcgagacctgaggccagacggaactacaacatgtaccatccacgagaattgtacccgtccctgggggccggctaccgcctggggcccgcccaacctggggccgactccagcttcccacccgccctagcggagggctaccgctaccccgaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacctgatcctgcactccatgcacaagtaccaaccccgcatacacctagttcgggcagcccagctctgcagccagcactgggggggcatggcctccttccgcttccccgagaccacattcatctccgtgacagcctaccagaacccacagatcacacaactgaagattgcagccaatccctttgccaaaggcttccgggagaacggcagaaactgtaagagggagcgagacgcccgtgtgaagaggaaactgcggggcccagagccagcagccacagaggcctatgggagcggagacacaccaggtggtccctgcgactccaccctgggtggagacattcgtgaatcagatccagaacaggccccagcccccggggaagccaccgctgccccggcacctctgtgtggtggccccagtgctgaggcctacctcctgcaccctgcggctttccatggggcccccagtcaccttcccaccaggagccccagcttcccggaggctccagactccgggcgctcagccccctactcggctgcatttctggagctgccgcacgggtcagggggctccgggtacccagcggctccaccggcggtaccctttgccccgcactttctccaagggggccccttccctctaccatacaccgcgcctgggggctatctggatgtgggctccaaacccatgtactgaaccactgctgggcccctctgcctccatcacaaacctcccgctcccttcccccagccctggagccccctcacctccaccggccccatcccccacaccaaatggccgccttgggcctgcccacccaccccctcaacttcacaccttgatttcactcccacccccctctggcttcaaagcctaaccaaggctgctgggagtccagctggggccggcttccccttcccggctctcacctccgtgtgaatggaaggggctctgcctggccaaatggggccacagaccagcatccccacttaccaggcctccccatgggctctggaggggctcaatccccacccccccacacacactggtgcaggccacaccagtctgttgttctgggaccagagtatttttgttaataaaactcaaaagccatccatgctcaggaaacattgggctcctgtgtttggccctgggcgggg

SEQ ID NO: 31157 - DNA, 2162 bp, Homo sapiens
agaagctgtcggactgtgagcgccttcgaactttggaggcttggctcgggatggaggtttttttagcatggggaccagggaggactacggtgctcgggactgggctgcggcctcctcgcggccccgagtgccctgtgaaatcagctcaggccgcgtccctctagcctgcactttccctctgttcacgctgcttccctccagggcccggcctccaagtgaaggggggcggagggcggtcacctgccagaaggtctggggcgccaaggtgtgtcccgggactcttggctccgtccaggttccaggccccgccccccagcttatccctagccggggctccccaccgtgggaacggggaccagctggccggaagcgccaaactgcgtccctgtccgagccctggggatcaatcaagccgaggagttaattatgtaatgagggggcagggggtcgaggctaatgaagcctcccggggtggggagggaggggaggaggggaccgtacccaggtatccgaccccctctcggaccccttcgaggccccaggggtctccaccccagcccaactccagggccccaaagaggggaggggctgtgatcctggatctggaaggggctgagctgtgagctataaagggggcatctcgcagcaccgggggccctaagcagcgagacctgaggccagacggaactacaacatgtaccatccacgagaattgtacccgtccctgggggccggctaccgcctggggcccgcccaacctggggccgactccagcttcccacccgccctagcggagggctaccgctaccccgaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacctgatcctgcactccatgcacaagtaccaaccccgcatacacctagttcgggcagcccagctctgcagccagcactgggggggcatggcctccttccgcttccccgagaccacattcatctccgtgacagcctaccagaacccacagatcacacaactgaagattgcagccaatccctttgccaaaggcttccgggagaacggcagaaactgtaagaggtgggagttgttcattcatttgttcatgcattcaacaaatgtttattaatcactcactgtgtgccaggcaccgtgctggacatcagaaatgcagtggtaagtgaaaacattcattcactgactcagcaaatacttatatagtacctgctatgtgccagggacagttccaggcactggagataaaacaaacaaagcaaaccaaagccccggccctcatgcagctgatttctagtggggagagtagacaagcagacaagagaaataaataaaatgtcatctgttaggaagccattctaaagagaagagagaccaggtgtggtggctcacgcatgtaatcccagcactctgggaggctgaggcgggcagatcacctgaggccaggagttcgagaccagcctgccaacatggtgaaaccctgtctctgctaaaaatacaaaaattagccaggcatggtggcaaacgcctgtaatcccaactacttgggaggctgaggcaggagaatctcttgaacccaggaggtggaggttgcagtgagtcgagatcatgccattgcattccagcctaggcaacacgagcaaaacttcctctcaaaaaaaaaaaaaaaaagaaagaaaagaaaactctgtctc

SEQ ID NO: 31158 - DNA, 4109 bp, Homo sapiens
agacgcggaccctcagggacactgcggacgcgagaaaggacacgccccctcgcgggagcataagtccaccgcacagaactcgcgcgcctcccctcgaacgaacgcgcacgcgcgcgcagggggcgggtcttcttcccgacacccactgagcgcccggcctcctcaccccaccccaccgaactccggccgcccaggctccgcctccgcgacgggccgtcgggaggaggcgaccggaagccacttaaagcagagatcgaggtgacaggcgagctggctggactcggagcgcggtcgaggctttctgcgttcgcggcggcggaatggcccgtgcgcggctcgccgcgtcgcggctctgtggtccctagacgtcggctcccgccctcggcgctgatctccggcgcgggcactgctttccactcggctcctgtcgtccgttctctcaggctcccgttcaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccaaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaacttatggtaattctttaaaa

SEQ ID NO: 31159 - DNA, 4181 bp, Homo sapiens
agtgcgagcgccggcctcgcggctccggccccggccccggccccgcgccggcagtgtgcggggctctcgcggatcggggtgattgattttgagactgccctttgtaccgaattcactcgggtcccgtcagcatgaagatggaattggtttacacttcttaggcacttagagcctgtggcaggtgtatacatcagaccgaggcgccgaaggatttagttggggtcgcaggcgcctgccccttccccgttcgtcagggtgggggcgcgtctatgcggcctcccccgcgggccgaccccgggtgctctgaggcgcctaggagcccttcccagaccccgggggggagggcacggcagctacgggagccttccggctaccccgcgtttcgggctgcagcccagaagtttggaagatgttttcacattaactttgagagcgcacaagtcttcgtcttcctccccgccgccgcgggaagcgctcgccgcctttcccccgcgcttcgcggctcagttctgcgagcccccaagacccgttggacgctcctcgggaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccaaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaa

SEQ ID NO: 31160 - DNA, 1770 bp, Homo sapiens
agagccgggcggcgcctcagctgcactgcgcggagttggcgcggcccgggaccaggagctgagcaaaccgccgcggccaacaggaggcgtcactcggacccgggctcggcgccggggtgtcgcgcggcggcgggcgggcaggctttggagcggcagttttttcggaaagtgcttttggccgggagtgccgcagaaccccagcgtcacgaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaat

SEQ ID NO: 31161 - DNA, 2035 bp, Homo sapiens
caccattcctttctcacctggcacaatctcagatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactg

SEQ ID NO: 31162 - DNA, 2150 bp, Homo sapiens
aaaagcataaagaatgtataacaacctaattgttacaagggagtggaattaataatctacaagaaggcacaaaaggacagaaaagaaacagaacaaatgagaaaaatagaaagccaacagtaatatggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatctt

SEQ ID NO: 31163 - DNA, 3681 bp, Homo sapiens
caccattcctttctcacctggcacaatctcagatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccaaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaacttatggtaattcttt

SEQ ID NO: 31164 - DNA, 3051 bp, Homo sapiens
gacatagctgccctaaaaggaatgaggaagcgagagctctccagtgtctggctggctccgtccgtgtgacagcccatgatgttctttccggtctctgtaatattctgaatttccacctgcccgccccttcgcttataatgcagagcatgtgaagggagaccggctcggtctctctctctcccagtggactagaaggagcagagagttatgctgtttctcccattctttacagctcaccggatgtaaaagaactctggctagagaccctccaaggacagaggcacagccacacgggagtgaaatccacccctggacagtcagccgcaatactgatgaagctgagaagcagccacaatgcttcaaaaacactaaacgccaataatatggagacactaatcgaatgtcaatcagagggtgatatcaaggaacatcccctgttggcatcatgtgagagtgaagacagtatttgccagctcattggacattctcactattctatgccttaaaggcccttcaacggaagggatattcaggagagcagccaacgagaaagcccgtaaggagctgaaggaggagctcaactctggggatgcggtggatctggagaggctccccgtgcacctcctcgctgtggtctttaaggacttcctcagaagtatcccccggaagctactttcaagcgacctctttgaggagtggatgggtgctctggagatgcaggacgaggaggacagaatcgaggccctgaaacaggttgcagataagctcccccggcccaacctcctgctactcaagcacttggtctatgtgctgcacctcatcagcaagaactctgaggtgaacaggatggactccagcaatctggccatctgcattggacccaacatgctcaccctggagaatgaccagagcctgtcatttgaagcccagaaggacctgaacaacaaggtgaagacactggtggaattcctcattgataactgctttgaaatatttggggagaacattccagtgcattccagtatcacttctgatgactccctggagcacactgacagttcagatgtgtcgaccctgcagaatgactcagcctacgacagcaacgaccctgatgtggaatccaacagcagcagtggcatcagctctcccagcaggcagccccaggtgcccatggccacagctgctggcttggatagcgcgggcccacaggatgcccgagaggtcagcccagagcccattgtgagcaccgtggccaggctgaaaagctccctcgcacagcccgataggagatactcagagcccagcatgccatcctcccaggagtgcctcgagagccgggtgacaaaccaaacactaacaaagagtgaaggggacttccccgtgccccgggtaggctctcgtttggaaagtgaggaggctgaagacccatttccagaggaggtcttccctgcagtgcaaggcaaaaccaagaggccggtggacctgaagatcaagaacttggccccgggttcggtgctcccgcgggcactggttctcaaagccttctccagcagctcgctggacgcgtcctctgacagctcgcccgtggcttctccttccagtcccaaaagaaatttcttcagcagacatcagtctttcaccacaaagacagagaaaggcaagcccagccgagaaattaaaaagcactccatgtctttcacctttgcccctcacaaaaaagtgctgaccaaaaacctcagcgcgggctctgggaaatcgcaagactttaccagggaccacgtcccgaggggtgtcagaaaggaaagccagcttgccggccgaatcgtgcaggaaaatgggtgtgaaacccacaaccaaacagcccgcggcttctgcctgagaccccacgccctctcggtggatgatgtgttccagggagctgactgggagaggcctggaagcccaccctcttatgaagaggccatgcagggcccggcagccagactagtggcctccgagagccagaccgtggggagcatgacggtggggagcatgagggcgaggatgctggaggcgcactgcctcctaccccctcttccacctgctcaccacgtagaggactcaagacacaggggcagcaaagagccactccctggccacggactctctcccctgcctgagcgatggaaacagagcagaactgtccatgcttctggggactctctggggcacgtgtctggcccagggagacctgagctcctcccgctgaggaccgtctccgagtccgtgcagaggaataagcgggactgtctcgtgcgacgatgtagccagccggtctttgaggctgaccaattccaatatgccaaagaatcgtatatttaggagggaggccatacgccatgccatagcttgtgctatctgtaaatatgagacttgtaaagaactgcctgtagattgtttttaaaaggtcttgaataagctccttgagaaagttgtggaaagccctcctcagtgaggatagctacaccatggccatggcgcatcagatagtctctgtgtacctggatttgtgcaatatgtaaaaatgtatcaaatgtattatagataaggtgttaggtgcaaaggatgtctaataatccctgcacacgttttgaacttgcagtgaagtacactgctgttccttgcttcctggggcacttttctcttggttagtgtttaaaaattatcttcgcttttttaatgtggcctcaaatgtcatgccaattttcacatcttccacaaactccatttagggagaaatgtttaaatctctggtataagtttactccataccagagtaaactatatattactctatataagcagtcttgcaataactaatcaccaccatagaagaaagaaacagactgcaaggaacagagttgagtgtctggagtcatcaaaggcattaaaaactccagtaaaagctggggccgtagcaaaaatcatgaaaaacacttcaacgtgtcctttcaatcatccaattaaatgtgggtagattaatgaaaatgtattacatcaatattaactcat

SEQ ID NO: 31165 - DNA, 1183 bp, Homo sapiens
ataatgcagagcatgtgaagggagaccggctcggtctctctctctcccagtggactagaaggagcagagagttatgctgtttctcccattctttacagctcaccggatgtaaaagaactctggctagagaccctccaaggacagaggcacagccacacgggagtgaaatccacccctggacagtcagccgcaatactgatgaagctgagaagcagccacaatgcttcaaaaacactaaacgccaataatatggagacactaatcgaatgtcaatcagagggtgatatcaaggaacatcccctgttggcatcatgtgagagtgaagacagtatttgccagctcattgaagttaagaagagaaagaaggtgctgtcctggccctttctcatgagaaggctctcccctgcatcagatttttctggggctttggagacagacttgaaagcatcgctatttgatcagcccttgtcaattatctgcggtgacagtgacacactccccagacccatccaggacattctcactattctatgccttaaaggcccttcaacggaagggatattcaggagagcagccaacgagaaagcccgtaaggagctgaaggaggagctcaactctggggatgcggtggatctggagaggctccccgtgcacctcctcgctgtggtctttaaggacttcctcagaagtatcccccggaagctactttcaagcgacctctttgaggagtggatgggtgctctggagatgcaggacgaggaggacagaatcgaggccctgaaacaggttgcagataagctcccccggcccaacctcctgctactcaagcacttggtctatgtgctgcacctcatcagcaagaactctgaggtgaacaggatggactccagcaatctggccatctgcattggacccaacatgctcaccctggagaatgaccagagcctgtcatttgaagcccagaaggacctgaacaacaaggtttgttctgcttactgatgagaaatccccaacttatgatctcaccatctgtttgccaagtccaggcaataaaatgcttcagaatgtctccaactgactcagaatcacagtgaaaatataaaatgcaaaatgcttttgtcatagttccactctctcagatacatgtatctaatgaaactgaataaatccgtgtcttctgtca

SEQ ID NO: 31166 - DNA, 3887 bp, Homo sapiens
gacatagctgccctaaaaggaatgaggaagcgagagctctccagtgtctggctggctccgtccgtgtgacagcccatgatgttctttccggtctctgtaatattctgaatttccacctgcccgccccttcgcttataatgcagagcatgtgaagggagaccggctcggtctctctctctcccagtggactagaaggagcagagagttatgctgtttctcccattctttacagctcaccggatgtaaaagaactctggctagagaccctccaaggacagaggcacagccacacgggagtgaaatccacccctggacagtcagccgcaatactgatgaagctgagaagcagccacaatgcttcaaaaacactaaacgccaataatatggagacactaatcgaatgtcaatcagagggtgatatcaaggaacatcccctgttggcatcatgtgagagtgaagacagtatttgccagctcattgaagttaagaagagaaagaaggtgctgtcctggccctttctcatgagaaggctctcccctgcatcagatttttctggggctttggagacagacttgaaagcatcgctatttgatcagcccttgtcaattatctgcggtgacagtgacacactccccagacccatccaggacattctcactattctatgccttaaaggcccttcaacggaagggatattcaggagagcagccaacgagaaagcccgtaaggagctgaaggaggagctcaactctggggatgcggtggatctggagaggctccccgtgcacctcctcgctgtggtctttaaggacttcctcagaagtatcccccggaagctactttcaagcgacctctttgaggagtggatgggtgctctggagatgcaggacgaggaggacagaatcgaggccctgaaacaggttgcagataagctcccccggcccaacctcctgctactcaagcacttggtctatgtgctgcacctcatcagcaagaactctgaggtgaacaggatggactccagcaatctggccatctgcattggacccaacatgctcaccctggagaatgaccagagcctgtcatttgaagcccagaaggacctgaacaacaaggtgaagacactggtggaattcctcattgataactgctttgaaatatttggggagaacattccagtgcattccagtatcacttctgatgactccctggagcacactgacagttcagatgtgtcgaccctgcagaatgactcagcctacgacagcaacgaccctgatgtggaatccaacagcagcagtggcatcagctctcccagcaggcagccccaggtgcccatggccacagctgctggcttggatagcgcgggcccacaggatgcccgagaggtcagcccagagcccattgtgagcaccgtggccaggctgaaaagctccctcgcacagcccgataggagatactcagagcccagcatgccatcctcccaggagtgcctcgagagccgggtgacaaaccaaacactaacaaagagtgaaggggacttccccgtgccccgggtaggctctcgtttggaaagtgaggaggctgaagacccatttccagaggaggtcttccctgcagtgcaaggcaaaaccaagaggccggtggacctgaagatcaagaacttggccccgggttcggtgctcccgcgggcactggttctcaaagccttctccagcagctcgctggacgcgtcctctgacagctcgcccgtggcttctccttccagtcccaaaagaaatttcttcagcagacatcagtctttcaccacaaagacagagaaaggcaagcccagccgagaaattaaaaagcactccatgtctttcacctttgcccctcacaaaaaagtgctgaccaaaaacctcagcgcgggctctgggaaatcgcaagactttaccagggaccacgtcccgaggggtgtcagaaaggaaagccagcttgccggccgaatcgtgcaggaaaatgggtgtgaaacccacaaccaaacagcccgcggcttctgcctgagaccccacgccctctcggtggatgatgtgttccagggagctgactgggagaggcctggaagcccaccctcttatgaagaggccatgcagggcccggcagccagactagtggcctccgagagccagaccgtggggagcatgacggtggggagcatgagggcgaggatgctggaggcgcactgcctcctaccccctcttccacctgctcaccacgtagaggactcaagacacaggggcagcaaagagccactccctggccacggactctctcccctgcctgagcgatggaaacagagcagaactgtccatgcttctggggactctctggggcacgtgtctggcccagggagacctgagctcctcccgctgaggaccgtctccgagtccgtgcagaggaataagcgggactgtctcgtgcgacgatgtagccagccggtctttgaggctgaccaattccaatatgccaaagaatcgtatatttaggagggaggccatacgccatgccatagcttgtgctatctgtaaatatgagacttgtaaagaactgcctgtagattgtttttaaaaggtcttgaataagctccttgagaaagttgtggaaagccctcctcagtgaggatagctacaccatggccatggcgcatcagatagtctctgtgtacctggatttgtgcaatatgtaaaaatgtatcaaatgtattatagataaggtgttaggtgcaaaggatgtctaataatccctgcacacgttttgaacttgcagtgaagtacactgctgttccttgcttcctggggcacttttctcttggttagtgtttaaaaattatcttcgcttttttaatgtggcctcaaatgtcatgccaattttcacatcttccacaaactccatttagggagaaatgtttaaatctctggtataagtttactccataccagagtaaactatatattactctatataagcagtcttgcaataactaatcaccaccatagaagaaagaaacagactgcaaggaacagagttgagtgtctggagtcatcaaaggcattaaaaactccagtaaaagctggggccgtagcaaaaatcatgaaaaacacttcaacgtgtcctttcaatcatccaattaaatgtgggtagattaatgaaaatgtattacatcaatattaactcatctatagcactttgagtatctttgtagttcatgatatcctatcctataatgtggaggtaaatgattttatatgcattgggggtcatatataaaacttcaatgtaatttcactacaataaattgccttccttatttgaaagtaaaaatgttctttttttattgacatgttaactcctttccctcaattaatagaaatccactaagaaaatcattcacatattggttcactcaacaagcatttattaaatatatattcactattctagactaatagcaagaccggggatcttgtttaggaagaagcagtccctgttctccagaatttgcaaaaccattaaaaaagcacctactttaagccattttttttcagcaaggagtcattctgccagaaaaatgtagtacacaaatacaggataatataacaaatgtaaaatttctcatttctagtgaattaaactttccagtaattttacatctcacctcattcttatgatgctcagtttgcttaattattggcaaacataatggtaaaatgtttgtactgtattagagctttactgttcgattattaagatatttatccagtatcttagagatgctggacttcaattttccttattttatctttttaaaataaaatatcatgcatgcttctgatttgttatagaaa

SEQ ID NO: 31167 - DNA, 828 bp, Homo sapiens
atggccacagctgctggcttggatagcgcgggcccacaggatgcccgagaggtcagcccagagcccattgtgagcaccgtggccaggctgaaaagctccctcgcacagcccgataggagatactcagagcccagcatgccatcctcccaggagtgcctcgagagccgggtgacaaaccaaacactaacaaagagtgaaggggacttccccgtgccccgggtaggctctcgtttggaaagtgaggaggctgaagacccatttccagaggaggtcttccctgcagtgcaaggcaaaaccaagaggccggtggacctgaagatcaagaacttggccccgggttcggtgctcccgcgggcactggttctcaaagccttctccagcagctcgctggacgcgtcctctgacagctcgcccgtggcttctccttccagtcccaaaagaaatttcttcagcagacatcagtctttcaccacaaagacagagaaaggcaagcccagccgagaaattaaaaagcactccatgtctttcacctttgcccctcacaaaaaagtgctgaccaaaaacctcagcgcgggctctgggaaatcgcaagactttaccagggaccacgtcccgaggggtgtcagaaaggaaagccagcttgccggccgaatcgtgcaggaaaatgggtgtgaaacccacaaccaaacagcccgcggcttctgcctgagaccccacgccctctcggtggatgatgtgttccagggagctgactgggagaggcctggaagcccaccctcttatgaagaggccatgcagggcccggcagccagaccgtggggagcatga

SEQ ID NO: 31168 - DNA, 630 bp, Homo sapiens
ccctgagggccctttctctttccatctcaggaactcaaacatgaccaggaagatcttcacaaataccagggagcggtggaggcagcagaatgtcaacagcgcctttgccaagctgaggaagctcatccccactcaccctccagacaaaaagctgagcaaaaatgaaacgcttcgcctggcaatgaggtatatcaacttcttggtcaaggtcttgggggagcaaagcctgcaacaaacgggagtggctgctcaggggaacattctggggctcttccctcaaggaccccacctgccaggcctggaggacagaactctgcttgagaactaccaggttccttcacctggtccaagccaccacattccttagtgtggctctggctgtcatctcccagggcagcacttgcccagaaatcactgcctgtggacagacttttgcatgttccagagttgacctgatgataactcgtgaagcatgaattctagcttcctgggaggtggctcagagacagctgcagggagctgaaagaagccatgaggaatgtcacttgtgggccgccaccccccagggatgtcaggtagagcggcctacctctgcctattttaaatccaggttctgcataagacttttgg

SEQ ID NO: 31169 - DNA, 2137 bp, Homo sapiens
ccacccgggacttgggcagcggcgccggcagcccagcgtctatttgcgcttaagagccagcaaggaagctccaggggccccagctggccgtgctcccccgggatgcaagtccctgcgctgacgcccggcagcggctggcacgggcgcggctgctccgggtgcacagggatgctgctgtttcggggaccccggcgccctgccttggccagccccgcgggcccctgaggccactctccggagcgcgccgccgctgggcttctggcgctgcctgaggcatcctccccaaccaccgaacctccggcggttctcctcggcccagaccgatggagccggggatgctgggtccacacaacctcccacaccacgagccaatcagcttcggcatcgatcagatcctgagcggccccgaaaccccagggggcggtctaggcctgggtcgcgggggccagggtcatggggagaatggggcgttctcgggtggataccacggagcctcgggctacggtcccgccggctcacttgccccgctgcccggcagctccggagtgggcccaggcggcgtgatccgcgtccctgcgcaccgcccgctgcctgtgccgccgcccgctgggggggcgcctgcagtgcctgggccctcgggtttgggcggcgccggaggcctagcgggactcaccttcccctggatggacagcggccgccgctttgccaaggaccggctcacggctgcgctctcgcccttctctgggacgcgccgcataggccacccctaccaaaaccggacccctccgaagcggaagaagccgcgcacgtccttctcccgctcacaggtgctggagttggagcggcgcttcctgcgccagaagtacctggcctctgcggagagggcggcgctggccaaggccttgcgcatgaccgacgcacaggtcaaaacgtggttccagaaccgacgcaccaagtggcggcgccagacggcggaggagcgcgaggccgagcggcaccgcgcgggccggctgctcctgcatctgcagcaggacgcgttgccacggccgctgcggccgccgctgcccccggaccctctctgcctgcacaactcgtcgctcttcgcgctgcagaacctgcagccctgggccgaggacaacaaagtggcttcagtgtccgggctcgcctcggtggtgtgagcgacgcccgtccgatcggcgtggagcgccgggcccggagcggtggagcgcgcggctgcctgcgtccatggtctagtggcagccgggcgcgtgaggagcggcaggccttgaggctgtcgtcgagggctcctccaccaccggccggctcccaagccagcgttgcgcagatgcacggccagctcagaggcggcctttcccgccatttttcacttcactgccgttacgccctcgctggaacctgaggcgccgagagggcgggacctgcaggacagtagccaatgaggtgcggggagggggccgggctggccaatgggagctgctttcctgagggactcgaaattctccggcgggtggtcgggagctggggctctgaggggctctagcggcgttgcgcgcggtgccggctgggtctgtaccaaaggtgtgaaggaaagaagacaccgaccacggcgaagcaatagagggggtgctggagcgcgagaggctggctgattgtgaccgaaaccagagggttgtccaccccgggcatctcatccctcaactgtaaaataatcgctaaggattccttcctgactttgagcctcacgttgtcatgtgtgttcagcctgctggccacatcctccggcaacacgcccgggcaggaggcgagtcggatacttacacacccaacgaaagagaaaatctggctccggtgtcacatagggacagagaagggagaggaggaaacagtggacaaagttaatgggcccagtggagttagggtgaagagaatttggaaaataatttggaagtgacaagcttaagaagaatcaaaggtaattccaagactggaaatgtgcagcatcaggaaatcaatggtgctgtggatgatgaaagggaaattgggaagactggagcaaaattaactgtataggcaaaactaaatgttatacctagagagaataaatcctggagaagtg

SEQ ID NO: 31170 - DNA, 1883 bp, Homo sapiens
gccgggcgctccatggccgcgccgtaacggggacccagccgcctccccgcccagcccagcccagcccttccgcccgcccaggatggaggcgcccgccagcgcgcagaccccgcacccgcacgagcccatcagcttcggcatcgaccagatccttaacagcccggaccaggacagcgcacccgccccgcggggccccgacggcgccagctacctgggagggccccccgggggccgtccgggcgccacatacccgtctctgcccgcctcctttgcgggcctcggcgcgcccttcgaggacgcgggatcttacagtgtgaacctgagcctagcgcccgcaggcgtgatccgggtgccggcgcacaggccgctgcccggggccgtgccaccgcctctgccaagcgcgctacccgccatgccctccgtgcccacggtctccagccttggcggtctcaatttcccctggatggagagcagccgccgcttcgtgaaagaccgcttcacagcggcggccgcactcacgcccttcaccgtgacccggcgcatcggccacccctaccagaaccggacgccgcccaagcgtaagaagccgcgcacgtccttttcccgggtgcagatctgcgagctggaaaagcgcttccatcgccagaagtacctggcctctgccgagagggcggcgctcgccaagtccctcaaaatgacggacgcgcaggtcaagacctggttccaaaaccggaggaccaagtggcggcggcagacggcggaggagcgggaggcggagcggcagcaggcgagccggctcatgctgcagctgcaacacgacgccttccaaaagagcctcaacgactccatccagcctgacccgctctgtctgcacaactcgtcactctttgctctgcagaatctgcagccctgggaggaggatagttccaaggttcccgctgtcacctccctggtgtgagcccaccagcgcgcaccgtcgccacggatcgccgcccccacccagccgggcgccccggaccccccaggcgggctgcgggggaaccggcgccgagaggggaaggggccgcctagcccgagtaggccccagggcgcggccacagactggcgggccgcggaagggggtagggcccgagctccgcgcggccgcacaatccgagcccccgccccgcgccccgtcccgccccaggcccgggcctgacaagaaagcgccttacgtttctccgccccccgcccgcaccccccgggccgggcgcctgtattatactttgtacttttgcccaaacgtgtaaataataaaaaagttttggcttttttctttagaaaccggccacctgcttcccccgcgggggccgctggaggaagggcagccgacccggccgctgggggaagtgccaggggcccggggcaccctgcgtttaggctgggtccactcttcttcttttccgttccttttatttaagtctttttatttaataaaaaagttagctatttcacttaacgccgcttttatttcgttttcgttccaataatgctcggcgacccccggccctgcgccccacccctgcggcggtagaagccgagcggcggcgcgcagggcgcgtccacttccgcaacgttcgtctgcattcgcctcggctgcaaccccggcccgggcccccgaggaggatgcgcggtgcaggtcagttggtgccggccacccgcagcctgggtgcgcacgggatggggactggacatgggaaaggtgctccaggcccgaaggccgcgggccagcgccggggcgggctggggagtgaaaggctgggcctgggcagatgcctaggccgtccccaggtcaaatccacctggggggtgggaggcagggtggcctcgaacttcttagagct

SEQ ID NO: 31171 - DNA, 2146 bp, Homo sapiens
tactcccggagtcactcatcccttaagcaagcagggtggggttaggtgcgcgtgcgcggttttaatactcctccccgaactgccaactcttcacgcacgcgaagtaggccccaccctggctgggtttacgcgtgcgcactaacgggcctggtcccggaagaccacacgcgtgcgtggtggggactacggtgacagtaccccgggtggggcgagggccagtcatggcggagtcctggtctgggcaggccttgcaggctctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggtctgggtggtcagaatggatccacgcctgatggctccacgcatttcccttcgtgggaaatggcagcaaacgaacctctcaaaacccacagagaataagggaaggcagcagagggtctccaagggcatcactgggtctgctggcttctacactgggttctgctactccccagacctcagggacaactgccgggggttcagggttggtagcagggagtacccagtgcctacagggctgggcctcttctgcctcttaagcctgctccctcacccaggcactgggcaagtgaagagtttgcctgtactcttatctgggtgccttaaggagagagattgtgttcttcctctctcaggggtgataactcaggaagcctctgggttgggaagaccatcagttcttttgtcttaggtttcttttcctgtccctcttccatccccaagatgtgaccccataaaaatttttcctgagttggccaggcatggtggctcacgcctgtaatcccaacactttgggaggctgaggcaggcagatcacgaggtcaggagttcgagaccagcctgaccaacatggtgaaaaccccatctctactaaaaatacaaaaattagccgggtgtggtggcacacaccagtaatcccagctactcaggaggctgaagcaggagatttgcttgaacctgggaggcagaggttgcagtgagccaagattgcgccgttgtactccagcctgggcaacagagcaagacccatctcaaaaaaaaaatttttttcctgagaggaagcctgaggttgaccagctctggggtttgtaaggcaggtctgttttctcctaggccctgagttttctgaatctctggttttgctttgttggcaaggagccagggaatcctgacctgagccagaccttaagctctatggttatttagctggccattcaggtataaggcagggtggtgtacctgctggcactatccagatggaggcaccaaacacccacatacctggcccaaccagacttctcccgtgagccaggcaaaggaaattgtcatctgccaactgtcctactcatattcctctcagtccttcttgggggtaagctgattacctgaaggacagctgaacccctggggtagcctcctatccaccactgcttaagtgcctatgggaatgtgggtctgcaccttgtcccctcataggatggtaccaagcatttagtgcacagtggccccatcatagcctgcagcctcatcatttcccatctggacctggtacaaatgcacgtcacaggctcagctcctccccactagcattttctctaccttcaagaaccaggcagccctgccatgtcacaataggccaggggagtttccaaagatgtgggtggcaaatgcccctatagaaacaccagtacctgaaagcactgtagccctggacctgcctccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgc

SEQ ID NO: 31172 - DNA, 1151 bp, Homo sapiens
tggaaagctacacgtgtgagcctagaggcgggtcccggttgcagacttgccatggcctccgaagcttctgtgcgtctaggggtgccccctggccgtctgtggatccagaggcctggcatctacgaagatgaggaggggagaacctgggtgactgtggtcgtgcggttcaatccctcgcgtagggaatgggccagggcctcccagggcagcagatatgaacccagcatcacagtgcacttgtggcagatggcagtgcatacccgggagctactctcctccggccagatgcccttctcccagctgcccgccgtgtggcagctctaccccgggaggaagtaccgagcagcggattccagtttctgggaaatagcagaccatggccagattgactctatggagcagctggtcctaacatatcagccggagaggaaagactgacactgggagtggctggccctgctggccctgcctcttctggcctggtgtctcctcatgccccctcagtgaggatcttcatgtacctgctcttctgtttgcacacccagcatagcctccttgcaggcagaaggcagtagggcccctgcacactcagtttctctcgttttccttagttatcagtcctgtcctgtcccactcaggtctgtacttagggcagctggcctggatgggcttcactggggccctgtctgtgtgctgagccagtttcccctgctggctgcaagctgtgggttctttctcctctgtgcccctcatgctgatcttctagatgccactcccaaatccccttcatacccaccaggatgtgtgcccagccaggcctccagcacccccagtgcagctcgtgattggaaactcaccatcggcaggcagtggttcggtttaagagatggcattagagggagcccagtctggatgtggacttggatgccctgtgggtatcagttctgctgacactttggcccgaaatagatccagtgctgagcaagcaatgtacaccagagcctcagtgagcccatctgcacagtggggagcatggagggatgggtttggcctgtgcttctgcttattcagtccttcagctcacggaagggatgctagtccgtgaaggtgacctcacagtactggttaattaaactttattgctcactgtc

SEQ ID NO: 31173 - DNA, 1738 bp, Homo sapiens
acacgtgtgagcctagaggcgggtcccggttgcagacttgccatggcctccgaagcttctgtgcgtctaggggtgccccctggccgtctgtggatccagaggcctggcatctacgaagatgaggaggggagaacctgggtgactgtggtcgtgcggttcaatccctcgcgtagggaatgggccagggcctcccagggcagcagatatgaacccagcatcacagtgcacttgtggcagatggcagtgcatacccgggagctactctcctccggccagatgcccttctcccagctgcccgccgtgtggcagctctaccccgggaggaagtaccgagcagcggattccagtttctgggaaatagcagaccatggccagattgactctatggagcagctggtcctaacatatcagccggagaggaaagactgacactgggagtggctggtatgttggggccctgtgcgtctcagtgtagggatcagacgaaagtgagaagacctctcctcttttcagaaagacggcgtggcctcctcctccctgctgtttgctgagatttttcttacatagccacctgtcacctctgttccccagccccttggatgtgatggtacacagtgggtgggcccccataataagttcctaaagcatgggatctcatcgaataagactcatcatttaatccttgtgagaattttgtgaggtgtacgtgttaatgtcccatttcacgacgaaaagacaagactctggggatgggaatgacttcctcgagaccatacagccaggaaatagcggtgaatctagtgatctcgggtccctagatttaaccatggcactgaggtgccgtgtgacggtggccttggaggacccagcactgacccatagagggctcctctcagatgggcagcagcttggagcaggccaggcagggcctgggccattggaggggctggcactggacttgcctttgaccccagcagcttggatggggtgccgggctcccccatagttcactgactgtctcctttggtcttctcgcaggccctgctggccctgcctcttctggcctggtgtctcctcatgccccctcagtgaggatcttcatgtacctgctcttctgtttgcacacccagcatagcctccttgcaggcagaaggcagtagggcccctgcacactcagtttctctcgttttccttagttatcagtcctgtcctgtcccactcaggtctgtacttagggcagctggcctggatgggcttcactggggccctgtctgtgtgctgagccagtttcccctgctggctgcaagctgtgggttctttctcctctgtgcccctcatgctgatcttctagatgccactcccaaatccccttcatacccaccaggatgtgtgcccagccaggcctccagcacccccagtgcagctcgtgattggaaactcaccatcggcaggcagtggttcggtttaagagatggcattagagggagcccagtctggatgtggacttggatgccctgtgggtatcagttctgctgacactttggcccgaaatagatccagtgctgagcaagcaatgtacaccagagcctcagtgagcccatctgcacagtggggagcatggagggatgggtttggcctgtgcttctgcttattcagtccttcagctcacggaagggatgctagtccgtgaaggtgacctcacagtactggttaattaaactttattgctcactgtcca

SEQ ID NO: 31174 - DNA, 7200 bp, Homo sapiens
gccccgcatcgtgcccggccccgtcgcggagatcccggacgaccgtcgcgggttgatggtcgcattccagatgtaaacagcttcagaagcctgacggtcatatggtagaatcactgtggactgagacccacctttctagacctgaagcccaggaggaggaagaggaggctggttggtaccatgggcataatgctctgaatcctagtctctcacctagtatgtgagcagtccctgcagatggcccatttggagatcttgacaaagcctcttctgtttccaatggggtttttggcgcattctcacagacttagatgaaactgtgatggccaccgcagggggcaggtgctgacatcgtccccagccctgtggctgttcatccggacatcatttccaacctcaatatctaaatgccacagtgctcttggagcaagttgggctggggaccactgttgccttttaagaccataaaaccatgggaaacgcagaaagtcaacatgtagagcacgagttttatggagaaaagcatgccagcctggggcgcaagcacacttcccgctccctgcgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctgtcagagagccaattccttgggtgacttgtatgctcagaaaaactctggagtgacagcaaacggggggccggggagcaaatttgcaggctactgtcggaatttggtgtctgatattcccaatcttgcaaaccataagatgccaccagctgctgctgaagagactcctccgtacagtaattataacacacttccctgtaggaaatctcactgtctctctgaaggtgccaccaacccacaaattagccatagcaacagcatgcaaggcagaagagctaaaacaactcaggatgttaatgcaggcgagggcagtgagtttgcagacagtgggattgaaggggccactaccgacacggacctcctgtccaggcgatctaatgccaccaactccagctactcacccaccacaggccgggcctttgtgggcagcgacagcggcagcagctccaccggggatgcggctcgtcagggggtgtacgagaacttccggcgggagctggagatgagcaccaccaacagcgagagcctggaggaggccggctcggcgcacagcgatgagcagagcagcggcaccctgagctctccgggccagtcggacatcctgctgaccgccgcacagggcacggtgcgcaaggccggcgccctggccgtcaagaacttcctggtgcacaagaagaacaagaaggtggagtcagccacccggaggaagtggaagcactactgggtgtccctgaaaggatgcacgctatttttctacgagagcgacggcaggtctgggatagaccacaacagcatccccaaacacgccgtctgggtggagaacagcattgtgcaggcggtgcctgagcaccccaagaaggactttgtcttctgcctcagcaattccctgggtgatgccttcctttttcagaccactagccagacggagcttgaaaactggatcaccgccatccactctgcctgcgccactgcggtcgcgaggcaccaccacaaggaagacacgctccgactcctgaaatcagagatcaaaaaactggaacagaagattgacatggatgaaaagatgaagaaaatgggtgaaatgcagctgtcttcagtcactgactcaaagaaaaagaaaacaatattagatcagatctttgtctgggagcaaaatctcgagcagttccaaatggacctgtttcgtttccgctgttatttagccagccttcagggtggggagctgccaaaccccaaaaggcttctcgcttttgcaagtcgaccaacgaaagtggccatgggccgccttggaatcttttcggtatcatcgtttcatgccctggtggcagcacgcactggtgaaactggagtgagaagacgtactcaggccatgtccagatccgcgagcaagcgaaggagcaggttttcttctctgtggggtctggatactacctccaaaaagaagcagggacggccaagcatcaatcaggtgtttggagagggaaccgaagctgtaaagaaatctttagagggaatatttgatgacattgttccagatggcaagagggagaaagaagtggtcttacctaacgttcaccagcacaaccctgactgcgacatttgggtccacgagtatttcactccatcctggttctgtctgcccaataatcagcctgccctgacggtcgtccggccaggcgacactgcacgggacaccctggagctgatttgcaagacacatcaactggatcattctgctcattacctgcgcctgaaatttctaatagaaaacaaaatgcagctctatgttccacagcccgaggaagacatctatgagctgctgtacaaagaaattgaaatctgtccaaaagtcactcagagcatccacattgagaagtcagatacagctgctgatacttacgggttttcactttcttctgtggaagaagatggtattcgaaggctgtacgtgaatagtgtgaaggaaaccggtttagcttccaagaaaggcctgaaagcaggagatgagattcttgagatcaataatcgtgctgctgacgccctgaactcttctatgctcaaagatttcctctcacagccctcgctgggcctcctggtgaggacctaccccgagctggaggaaggagtggagctgctggaaagcccgccccaccgagtggacggccctgccgaccttggcgagagccccctcgcctttctcaccagcaacccagggcacagcctttgcagcgagcagggcagcagtgctgagaccgctccagaggagaccgaggggccagacttggaatcctcagatgagactgatcacagcagcaagagtacagaacaggtggccgcattttgccgcagtttgcatgagatgaacccctctgaccagagcccatctcctcaggactccacggggcctcagctggcgaccatgagacaactctcggatgcagataagctgcgcaaggtgatctgcgagctcctggagacggagcgcacctacgtgaaggatttaaactgtcttatggagagatacctaaagcctcttcaaaaagaaacttttctcacccaggatgagcttgacgtgctttttggaaatttaacggaaatggtagagtttcaagtagaattccttaaaactctagaagatggagtgagactggtacctgatttggaaaagcttgagaaggttgatcaatttaagaaagtgctgttctctctggggggatcattcctgtattatgctgaccgcttcaagctctacagtgccttctgcgccagccacacaaaagttcccaaggtcctggtgaaagccaagacagacacggctttcaaggcattcttggatgcccagaacccgaagcagcagcactcatccacgctggagtcgtacctcatcaagcccatccagaggatcctcaagtacccacttctgctcagggagctgttcgccctgaccgatgcggagagcgaggagcactaccacctggacgtggccatcaagaccatgaacaaggttgccagtcacatcaatgagatgcagaaaatccatgaagagtttggggctgtgtttgaccagctgattgctgaacagactggtgagaaaaaagaggttgcagatctgagcatgggagacctgcttttgcacactaccgtgatctggctgaacccgccggcctcgctgggcaagtggaaaaaggaaccagagttggcagcattcgtcttcaaaactgctgtggtccttgtgtataaagatggttccaaacagaagaagaaacttgtaggatctcacaggctttccatttatgaggactgggaccccttcagatttcgacacatgatccccacggaagcgctgcaggttcgagctttggcgagtgcagatgcagaggcaaatgccgtgtgtgaaattgtccatgtaaaatccgagtctgaagggaggccggagagggtctttcacttgtgctgcagctccccagagagccgaaaggatttcctaaaggctgtgcattcaatcctgcgtgataagcacagaagacagctcctcaaaaccgagagccttccctcatcccagcaatatgtcccttttggaggcaaaagattgtgtgcactgaagggggccaggccggccatgagcagggcagtgtctgccccaagcaagtctcttgggaggaggaggcggcggctggctcgaaacaggtttaccattgattctgatgccgtctccgcaagcagcccggagaaagagtcccagcagccccccggtggtggggacactgaccgatgggtagaggagcagtttgatcttgctcagtatgaggagcaagatgacatcaaggagacagacatcctcagtgacgatgatgagttctgtgagtccgtgaagggtgcctcagtggacagagacctgcaggagcggcttcaggccacctccatcagtcagcgggaaagaggccggaaaaccctggatagtcacgcgtcccgcatggcacagctcaagaagcaagctgccctgtcggggatcaatggaggcctggagagcgcaagcgaggaagtcatttgggttaggcgtgaagactttgccccctccaggaaactgaacactgagatctgactgcgtcacctgccccgtagagaatgtgtgtagatacttcctgccctaactctgcccaccctcctgtaccgtcgacaagaatgtccccttaggtcgcgctcttgcacacacggttttggcagctgacttggttctgaagccatgtagccacccaactttgtcattttcaacaacatcagaaagaattgatcagaatcccaaataagcttgagtcctatcttctgtatattactaagggcttttatttattctcaataaatcagggcctgaacaattaaaagaaaaaagattctatagcactggaaagcaaatcaccccaggagttaacggatgtacaacagattaatttaagggatagtagcacacacacgatccttctatctgaaatcagtctcctagctggggaaacctctttcacacacaaaatgaaatgtgtacagcttgccgtgttctgactgtacccttccctcttccatgtctgagaatctccgtgtattttaagaatgtgtgaggagagggtggcgattcatgtttcaatgagcctctttttttttttccttcctgttttggtctatggctggtcttactctgtgtccatgttcggaagctctagttttgcatagaattatagagatgccaaactctttgaaaagagatccaaatttatcgcttgagagaaagaaaagaaacactattttttgtattttacctgagatacaggggcacaaatagatgagaattttacagtgttagtgtatgtatccctgagcctaaaaaatgaggatataaccttttacagagagagtgaggcgtggtggttttatatttatatatgaaaggccagcaagctcatgcgaaggatatacttttcttccaaaaagcggattttttttttttaatgtttgaatctatatttgagatgggagtttggttggattaaacatgacaccccggtgggcggtgtgtgtgtctgttgcacatggcagggaggggagcctccttctcatggggttgccatggtgatcattggtttttccatcaaaattgcatcttcatccatagattaccttccccttccctgacagtccataaccaaacctttaaacagaacaacctctttaaaaacttctcttgtgtttaacactttcttcatgccaacgaaacagggtaaacatgctcaaaacattaacagtctaaacagatatccaaatactaagaagaaaaacaagttatagcactttcaattttttttttttttttaaaaaaaggtttatagctttttcttttcccatgtcacaatgtccacttcctaagaagggtttaaaatactatgaaaactttctttttggggaaaatatctatttggtgtttgacacatcagtaggtactttaaagacctgaattttatagtagctttaggagttatattttataaaaatcagttatgactttatatttccagacaatagagagttcagtacatcatgctcttgtgcctctgcctgcttttcctgcgttcccaccctgtattccccccgcctttcgggtttccagggcttcgagcttgatcttttgaaagttttattctattaaatttttgctatatcttctggttttctgaaaaagctttagaatggtttctataccctttgtatcactgcatttttccatatcatctccggttcgatcgcgtccagatggaaaacggaagcagaggcttctaatcgtcgcatttactggctccagtgcaacacatccatctgaaaacactcggaagtctggtgcttggagagggtgccattgtctcttgtacataaggtcatgacgtgtctatgtcaaaagttcttatatatttcttttataagctgaaagaaggtctatttttatgtttttaggtctatgaatggaacgttgtaaatgcttgtcaaacaataaaaataacgaaaagtgtc

SEQ ID NO: 31175 - DNA, 7193 bp, Homo sapiens
gccccgcatcgtgcccggccccgtcgcggagatcccggacgaccgtcgcgggttgatggtcgcattccagatgtaaacagcttcagaagcctgacggtcatatggtagaatcactgtggactgagacccacctttctagacctgaagcccaggaggaggaagaggaggctggttggtaccatgggcataatgctctgaatcctagtctctcacctagtatgtgagcagtccctgcagatggcccatttggagatcttgacaaagcctcttctgtttccaatggggtttttggcgcattctcacagacttagatgaaactgtgatggccaccgcagggggcaggtgctgacatcgtccccagccctgtggctgttcatccggacatcatttccaacctcaatatctaaatgccacagtgctcttggagcaagttgggctggggaccactgttgccttttaagaccataaaaccatgggaaacgcagaaagtcaacatgtagagcacgagttttatggagaaaagcatgccagcctggggcgcaagcacacttcccgctccctgcgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctgtcagagagccaattccttgggtgacttgtatgctcagaaaaactctggagtgacagcaaacggggggccggggagcaaatttgcaggctactgtcggaatttggtgtctgatattcccaatcttgcaaaccataagatgccaccagctgctgctgaagagactcctccgtacagtaattataacacacttccctgtaggaaatctcactgtctctctgaaggtgccaccaacccacaaattagccatagcaacagcatgcaaggcagaagagctaaaacaactcaggatgttaatgcaggcgagggcagtgagtttgcagacagtgggattgaaggggccactaccgacacggacctcctgtccaggcgatctaatgccaccaactccagctactcacccaccacaggccgggcctttgtgggcagcgacagcggcagcagctccaccggggatgcggctcgtcagggggtgtacgagaacttccggcgggagctggagatgagcaccaccaacagcgagagcctggaggaggccggctcggcgcacagcgatgagcagagcagcggcaccctgagctctccgggccagtcggacatcctgctgaccgccgcacagggcacggtgcgcaaggccggcgccctggccgtcaagaacttcctggtgcacaagaagaacaagaaggtggagtcagccacccggaggaagtggaagcactactgggtgtccctgaaaggatgcacgctatttttctacgagagcgacggcaggtctgggatagaccacaacagcatccccaaacacgccgtctgggtggagaacagcattgtgcaggcggtgcctgagcaccccaagaaggactttgtcttctgcctcagcaattccctgggtgatgccttcctttttcagaccactagccagacggagcttgaaaactggatcaccgccatccactctgcctgcgccactgcggtcgcgaggcaccaccacaaggaagacacgctccgactcctgaaatcagagatcaaaaaactggaacagaagattgacatggatgaaaagatgaagaaaatgggtgaaatgcagctgtcttcagtcactgactcaaagaaaaagaaaacaatattagatcagatctttgtctgggagcaaaatctcgagcagttccaaatggacctgtttcgtttccgctgttatttagccagccttcagggtggggagctgccaaaccccaaaaggcttctcgcttttgcaagtcgaccaacgaaagtggccatgggccgccttggaatcttttcggtatcatcgtttcatgccctggtggcagcacgcactggtgaaactggagtgagaagacgtactcaggccatgtccagatccgcgagcaagcgaaggagcaggttttcttctctgtggggtctggatactacctccaaaaagaagcagggacggccaagcatcaatcaggtgtttggagagggaaccgaagctgtaaagaaatctttagagggaatatttgatgacattgttccagatggcaagagggagaaagaagtggtcttacctaacgttcaccagcacaaccctgactgcgacatttgggtccacgagtatttcactccatcctggttctgtctgcccaataatcagcctgccctgacggtcgtccggccaggcgacactgcacgggacaccctggagctgatttgcaagacacatcaactggatcattctgctcattacctgcgcctgaaatttctaatagaaaacaaaatgcagctctatgttccacagcccgaggaagacatctatgagctgctgtacaaagaaattgaaatctgtccaaaagtcactcagagcatccacattgagaagtcagatacagctgctgatacttacgggttttcactttcttctgtggaagaagatggtattcgaaggctgtacgtgaatagtgtgaaggaaaccggtttagcttccaagaaaggcctgaaagcaggagatgagattcttgagatcaataatcgtgctgctgacgccctgaactcttctatgctcaaagatttcctctcacagccctcgctgggcctcctggtgaggacctaccccgagctggaggaaggagtggagctgctggaaagcccgccccaccgagtggacggccctgccgaccttggcgagagccccctcgcctttctcaccagcaacccagggcacagcctttgcagcgagcagggcagcagtgctgagaccgctccagaggagaccgaggggccagacttggaatcctcagatgagactgatcacagcagcaagagtacagaacaggtggccgcattttgccgcagtttgcatgagatgaacccctctgaccagagcccatctcctcaggactccacggggcctcagctggcgaccatgagacaactctcggatgcagataagctgcgcaaggtgatctgcgagctcctggagacggagcgcacctacgtgaaggatttaaactgtcttatggagagatacctaaagcctcttcaaaaagaaacttttctcacccaggatgagcttgacgtgctttttggaaatttaacggaaatggtagagtttcaagtagaattccttaaaactctagaagatggagtgagactggtacctgatttggaaaagcttgagaaggttgatcaatttaagaaagtgctgttctctctggggggatcattcctgtattatgctgaccgcttcaagctctacagtgccttctgcgcccacaaaagttcccaaggtcctggtgaaagccaagacagacacggctttcaaggcattcttggatgcccagaacccgaagcagcagcactcatccacgctggagtcgtacctcatcaagcccatccagaggatcctcaagtacccacttctgctcagggagctgttcgccctgaccgatgcggagagcgaggagcactaccacctggacgtggccatcaagaccatgaacaaggttgccagtcacatcaatgagatgcagaaaatccatgaagagtttggggctgtgtttgaccagctgattgctgaacagactggtgagaaaaaagaggttgcagatctgagcatgggagacctgcttttgcacactaccgtgatctggctgaacccgccggcctcgctgggcaagtggaaaaaggaaccagagttggcagcattcgtcttcaaaactgctgtggtccttgtgtataaagatggttccaaacagaagaagaaacttgtaggatctcacaggctttccatttatgaggactgggaccccttcagatttcgacacatgatccccacggaagcgctgcaggttcgagctttggcgagtgcagatgcagaggcaaatgccgtgtgtgaaattgtccatgtaaaatccgagtctgaagggaggccggagagggtctttcacttgtgctgcagctccccagagagccgaaaggatttcctaaaggctgtgcattcaatcctgcgtgataagcacagaagacagctcctcaaaaccgagagccttccctcatcccagcaatatgtcccttttggaggcaaaagattgtgtgcactgaagggggccaggccggccatgagcagggcagtgtctgccccaagcaagtctcttgggaggaggaggcggcggctggctcgaaacaggtttaccattgattctgatgccgtctccgcaagcagcccggagaaagagtcccagcagccccccggtggtggggacactgaccgatgggtagaggagcagtttgatcttgctcagtatgaggagcaagatgacatcaaggagacagacatcctcagtgacgatgatgagttctgtgagtccgtgaagggtgcctcagtggacagagacctgcaggagcggcttcaggccacctccatcagtcagcgggaaagaggccggaaaaccctggatagtcacgcgtcccgcatggcacagctcaagaagcaagctgccctgtcggggatcaatggaggcctggagagcgcaagcgaggaagtcatttgggttaggcgtgaagactttgccccctccaggaaactgaacactgagatctgactgcgtcacctgccccgtagagaatgtgtgtagatacttcctgccctaactctgcccaccctcctgtaccgtcgacaagaatgtccccttaggtcgcgctcttgcacacacggttttggcagctgacttggttctgaagccatgtagccacccaactttgtcattttcaacaacatcagaaagaattgatcagaatcccaaataagcttgagtcctatcttctgtatattactaagggcttttatttattctcaataaatcagggcctgaacaattaaaagaaaaaagattctatagcactggaaagcaaatcaccccaggagttaacggatgtacaacagattaatttaagggatagtagcacacacacgatccttctatctgaaatcagtctcctagctggggaaacctctttcacacacaaaatgaaatgtgtacagcttgccgtgttctgactgtacccttccctcttccatgtctgagaatctccgtgtattttaagaatgtgtgaggagagggtggcgattcatgtttcaatgagcctctttttttttttccttcctgttttggtctatggctggtcttactctgtgtccatgttcggaagctctagttttgcatagaattatagagatgccaaactctttgaaaagagatccaaatttatcgcttgagagaaagaaaagaaacactattttttgtattttacctgagatacaggggcacaaatagatgagaattttacagtgttagtgtatgtatccctgagcctaaaaaatgaggatataaccttttacagagagagtgaggcgtggtggttttatatttatatatgaaaggccagcaagctcatgcgaaggatatacttttcttccaaaaagcggattttttttttttaatgtttgaatctatatttgagatgggagtttggttggattaaacatgacaccccggtgggcggtgtgtgtgtctgttgcacatggcagggaggggagcctccttctcatggggttgccatggtgatcattggtttttccatcaaaattgcatcttcatccatagattaccttccccttccctgacagtccataaccaaacctttaaacagaacaacctctttaaaaacttctcttgtgtttaacactttcttcatgccaacgaaacagggtaaacatgctcaaaacattaacagtctaaacagatatccaaatactaagaagaaaaacaagttatagcactttcaattttttttttttttttaaaaaaaggtttatagctttttcttttcccatgtcacaatgtccacttcctaagaagggtttaaaatactatgaaaactttctttttggggaaaatatctatttggtgtttgacacatcagtaggtactttaaagacctgaattttatagtagctttaggagttatattttataaaaatcagttatgactttatatttccagacaatagagagttcagtacatcatgctcttgtgcctctgcctgcttttcctgcgttcccaccctgtattccccccgcctttcgggtttccagggcttcgagcttgatcttttgaaagttttattctattaaatttttgctatatcttctggttttctgaaaaagctttagaatggtttctataccctttgtatcactgcatttttccatatcatctccggttcgatcgcgtccagatggaaaacggaagcagaggcttctaatcgtcgcatttactggctccagtgcaacacatccatctgaaaacactcggaagtctggtgcttggagagggtgccattgtctcttgtacataaggtcatgacgtgtctatgtcaaaagttcttatatatttcttttataagctgaaagaaggtctatttttatgtttttaggtctatgaatggaacgttgtaaatgcttgtcaaacaataaaaataacgaaaagtg

SEQ ID NO: 31176 - DNA, 1187 bp, Homo sapiens
atcatagcacgaaacttcacaagttacacccactgcctccgccagcagccggggaaggctgctgcttcctcatttctgttactggaagtttgggacatgtgaagccagacggggagaaacgtgcgcgccttgttgagcagcggtagaatcactgtggactgagacccacctttctagacctgaagcccaggaggaggaagaggaggctggttggtaccatgggcataatgctctgaatcctagtctctcacctagtatgtgagcagtccctgcagatggcccatttggagatcttgacaaagcctcttctgtttccaatggggtttttggcgcattctcacagacttagatgaaactgtgatggccaccgcagggggcaggtgctgacatcgtccccagccctgtggctgttcatccggacatcatttccaacctcaatatctaaatgccacagtgctcttggagcaagttgggctggggaccactgttgccttttaagaccataaaaccatgggaaacgcagaaagtcaacatgtagagcacgagttttatggagaaaagcatgccagcctggggcgcaagcacacttcccgctccctgcgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctg

SEQ ID NO: 31177 - DNA, 4654 bp, Homo sapiens
agcaagttgggctggggaccactgttgccttttaagaccataaaaccatgggaaacgcagaaagtcaacatgtagagcacgagttttatggagaaaagcatgccagcctggggcgcaagcacacttcccgctccctgcgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctgtcagagagccaattccttgggtgacttgtatgctcagaaaaactctggagtgacagcaaacggggggccggggagcaaatttgcaggctactgtcggaatttggtgtctgatattcccaatcttgcaaaccataagatgccaccagctgctgctgaagagactcctccgtacagtaattataacacacttccctgtaggaaatctcactgtctctctgaaggtgccaccaacccacaaattagccatagcaacagcatgcaaggcagaagagctaaaacaactcaggatgttaatgcaggcgagggcagtgagtttgcagacagtgggattgaaggggccactaccgacacggacctcctgtccaggcgatctaatgccaccaactccagctactcacccaccacaggccgggcctttgtgggcagcgacagcggcagcagctccaccggggatgcggctcgtcagggggtgtacgagaacttccggcgggagctggagatgagcaccaccaacagcgagagcctggaggaggccggctcggcgcacagcgatgagcagagcagcggcaccctgagctctccgggccagtcggacatcctgctgaccgccgcacagggcacggtgcgcaaggccggcgccctggccgtcaagaacttcctggtgcacaagaagaacaagaaggtggagtcagccacccggaggaagtggaagcactactgggtgtccctgaaaggatgcacgctatttttctacgagagcgacggcaggtctgggatagaccacaacagcatccccaaacacgccgtctgggtggagaacagcattgtgcaggcggtgcctgagcaccccaagaaggactttgtcttctgcctcagcaattccctgggtgatgccttcctttttcagaccactagccagacggagcttgaaaactggatcaccgccatccactctgcctgcgccactgcggtcgcgaggcaccaccacaaggaagacacgctccgactcctgaaatcagagatcaaaaaactggaacagaagattgacatggatgaaaagatgaagaaaatgggtgaaatgcagctgtcttcagtcactgactcaaagaaaaagaaaacaatattagatcagatctttgtctgggagcaaaatctcgagcagttccaaatggacctgtttcgtttccgctgttatttagccagccttcagggtggggagctgccaaaccccaaaaggcttctcgcttttgcaagtcgaccaacgaaagtggccatgggccgccttggaatcttttcggtatcatcgtttcatgccctggtggcagcacgcactggtgaaactggagtgagaagacgtactcaggccatgtccagatccgcgagcaagcgaaggagcaggttttcttctctgtggggtctggatactacctccaaaaagaagcagggacggccaagcatcaatcagagggagaaagaagtggtcttacctaacgttcaccagcacaaccctgactgcgacatttgggtccacgagtatttcactccatcctggttctgtctgcccaataatcagcctgccctgacggtcgtccggccaggcgacactgcacgggacaccctggagctgatttgcaagctgtacaaagaaattgaaatctgtccaaaagtcactcagagcatccacattgagaagtcagatacagctgctgatacttacgggttttcactttcttctgtggaagaagatggtattcgaaggctgtacgtgaatagtgtgaaggaaaccggtttagcttccaagaaaggcctgaaagcaggagatgagattcttgagatcaataatcgtgctgctgacgccctgaactcttctatgctcaaagatttcctctcacagccctcgctgggcctcctggtgaggacctaccccgagctggaggaaggagtggagctgctggaaagcccgccccaccgagtggacggccctgccgaccttggcgagagccccctcgcctttctcaccagcaacccagggcacagcctttgcagcgagcagggcagcagtgctgagaccgctccagaggagaccgaggggccagacttggaatcctcagatgagactgatcacagcagcaagagtacagaacaggtggccgcattttgccgcagtttgcatgagatgaacccctctgaccagagcccatctcctcaggactccacggggcctcagctggcgaccatgagacaactctcggatgcagataagctgcgcaaggtgatctgcgagctcctggagacggagcgcacctacgtgaaggatttaaactgtcttatggagagatacctaaagcctcttcaaaaagaaacttttctcacccaggatgagcttgacgtgctttttggaaatttaacggaaatggtagagtttcaagtagaattccttaaaactctagaagatggagtgagactggtacctgatttggaaaagcttgagaaggttgatcaatttaagaaagtgctgttctctctggggggatcattcctgtattatgctgaccgcttcaagctctacagtgccttctgcgccagccacacaaaagttcccaaggtcctggtgaaagccaagacagacacggctttcaaggcattcttggatgcccagaacccgaagcagcagcactcatccacgctggagtcgtacctcatcaagcccatccagaggatcctcaagtacccacttctgctcagggagctgttcgccctgaccgatgcggagagcgaggagcactaccacctggacgtggccatcaagaccatgaacaaggttgccagtcacatcaatgagatgcagaaaatccatgaagagtttggggctgtgtttgaccagctgattgctgaacagactggtgagaaaaaagaggttgcagatctgagcatgggagacctgcttttgcacactaccgtgatctggctgaacccgccggcctcgctgggcaagtggaaaaaggaaccagagttggcagcattcgtcttcaaaactgctgtggtccttgtgtataaagatggttccaaacagaagaagaaacttgtaggatctcacaggctttccatttatgaggactgggaccccttcagatttcgacacatgatccccacggaagcgctgcaggttcgagctttggcgagtgcagatgcagaggcaaatgccgtgtgtgaaattgtccatgtaaaatccgagtctgaagggaggccggagagggtctttcacttgtgctgcagctccccagagagccgaaaggatttcctaaaggctgtgcattcaatcctgcgtgataagcacagaagacagctcctcaaaaccgagagccttccctcatcccagcaatatgtcccttttggaggcaaaagattgtgtgcactgaagggggccaggccggccatgagcagggcagtgtctgccccaagcaagtctcttgggaggaggaggcggcggctggctcgaaacaggtttaccattgattctgatgccgtctccgcaagcagcccggagaaagagtcccagcagccccccggtggtggggacactgaccgatgggtagaggagcagtttgatcttgctcagtatgaggagcaagatgacatcaaggagacagacatcctcagtgacgatgatgagttctgtgagtccgtgaagggtgcctcagtggacagagacctgcaggagcggcttcaggccacctccatcagtcagcgggaaagaggccggaaaaccctggatagtcacgcgtcccgcatggcacagctcaagaagcaagctgccctgtcggggatcaatggaggcctggagagcgcaagcgaggaagtcatttgggttaggcgtgaagactttgccccctccaggaaactgaacactgagatctgactgcgtcacct

SEQ ID NO: 31178 - DNA, 2677 bp, Homo sapiens
gcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaactttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctgttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggca

SEQ ID NO: 31179 - DNA, 842 bp, Homo sapiens
gcagcacacccggggttgttcccccaccccctgggaagtgctggaaggagcccggccctcgagccctcggcatagtggctgtgggagccctgatggccctgagccaggggtgacccctccccagatccccagagctgattccccacacctccttatttggccagcacagccccaaagggagccaggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaactttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgac

SEQ ID NO: 31180 - DNA, 220 bp, Homo sapiens
gatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccggtggaattccagaacaagttctactcaggcacgggctacaagctgagtcccttcaccttcgctgccacagatgactaggg

SEQ ID NO: 31181 - DNA, 2457 bp, Homo sapiens
ggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctgttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggca

SEQ ID NO: 31182 - DNA, 1477 bp, Homo sapiens
cctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctgttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggaggtgaggcccgggccccagcccggctgggggccccgcagcacccgcagccctgaccgccctcccctgcgttgccgcagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccggtggaattccagaacaagttctactcaggcacgggctacaagctgagtcccttcaccttcgctgccacagatgactagggcccactgcaggtcctgccagacctccttcctgacctctgaggcagga

SEQ ID NO: 31183 - DNA, 2499 bp, Homo sapiens
aaaaatgccgaccccgccccttccccggagcctcacttccgtcacagtcctgtttctctccctgttgtccctgcctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctaacgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattca

SEQ ID NO: 31184 - DNA, 1878 bp, Homo sapiens
gtcctgtttctctccctgttgtccctgcctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacggatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttg

SEQ ID NO: 31185 - DNA, 1671 bp, Homo sapiens
tccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgag

SEQ ID NO: 31186 - DNA, 984 bp, Homo sapiens
ggaactgtccgctgctctctggtctctggatatgaggcaggagggcttggggacaactgtggggacatggcccagatgatctgatcctggcagtagtgactgttggggaccaggatgctggcaggtcaactcgaggccagggaccccaaagagggcacccacccagaggacccgtgcccaggagctggggctgtcatggagaagacagctgtggcagccgaggttctcacggaggactgcaacactggggagatgccaccattacagcagcagatcatcagactccaccaagagcttgggagacagaagtctctgtgggctgatgttcatggaaaactccggagtcatatagatgctttgagggagcagaacatggagctccgagaaaagctgagagctctgcagctgcagcggtggaaagccaggaagaaatctgcagcgtccccacacgcggggcaagaatcgcacactctggcattggaacctgcttttggaaaaatttcacctctgtcagctgatgaagagacaatacccaaatacgctggccacaagaatcagagtgccactctcctgggacaaagatcgtcatctaacaattcagctcctccaaagccaatgagtttaaagatagaaagaattagctcgtggaaaacaccaccacaggaaaatagagataaaaatctttccaggagacgtcaagacagaagagcaacacctactggaaggccaactccctgtgcagagagacgggggggtgtctgaagatggaaaggtggcctcggacacctgtgtcactctacactggccccttggaaaattcagattcagataaagttccacttaggtctaataaaagtactcaatttgttattcaaaatagacctagtaatttattaaactaattatgtttctatagataaaaacttgaagttcttcagacatgtctctaatgctataaaagcaaacaacttggattgggtttta

SEQ ID NO: 31187 - DNA, 2141 bp, Homo sapiens
ggagatgaggcgggaggacttggggacagctgtggggacacggcccagatgctctggtcccagcagaagtgactggcggggaccaggatgctggagggtcagctcgaggccgggtagcccaaggagggcacccacccagaagacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggcattggaacctgcttttggaaaaatttcacatctgtcagctgatgaagacacaacgcccaaatacgctggccgcaagagtcagagtgccactctcctgggacaaagatggtcatctaaccacttagctcctccaaagccaatgagtttaaagacagaaagaattaactcggggaaaacaccaccacaggaagatagagagaaaagtcctcccgggagacgtcaagacagaagtccagcacccactggaaggccgactcccggtgcagaaagacggggggtgtctgaagacggaaagattatgcatccatcttcccgaagtccgcaaaactccggtggcagaaaatcaccagtgcaggcttcccaggccaccacgctgcaggagcagacggcagcagccagaggagctgacagaagctcatcagtcttagggagttctgaaggcggatttctcagccgcgttcaagctgacgagttcgccagttctgccccagacagtgcagagcggcagaatcttcctgtaaacccaccatcttccctggaaatagcacaggccatggacactaagatgaaaaaggaggaagtacaggaagaaaaacgacatccaaagggcaaggcagatgactgccggcggtccggtttcccgagtgaatttccaggagctctgcacgccgctccctccagacaggacatggggccctgacctggaggccaggcgtttctagcattgttgactgccagtttattcccagtaaataaagcaatacgcttttcaggaggaagatttgttttaaatacttaaaaaaaaacccaaaactatagcctcaaatatcttccagccaccacattttagcccttgaggagagctcagttccggaaggacgcgtcaaggtggcggtggtcggcattgactcaggaaggggtgggaagaggcacctgctgcggctgcggctgcggctacagtgttttgtgagctccgaggagacccagtcctgcctggggcagcacatcatcgctgcttcttcagctcaacagttcgttcatctcacgcctcttgctggcctgttagaaactgggagtcggcctcaggctagctttgctgagggaactctgcctcagtaaaagcgaattcatgtcttgcaagcgggtaaagcatttggataaatgaacaacagggaatgctacttgcagtaacagtttgaattcactgaaatgcttttgtctttagcgcagtggttgtagtggtttgtcaggggagaaggaaacccacatcatttgagcacctgaccttgccatccccgtaggcaggtccatgagacataagtgatgctcctccttggctaagtgcatggaggaaccaatcgctgaagctcatgaaaccacgaagatgaggacacaagaactaggtaacgcgctgtgccctctgctagcgcgatccttcctttctccccacaaccagcggtcacccacctctgcctgcccctatgtctctggctcccccaccctccctcccaggtcttcagcactttcctcttctcgtgactcatcttgcatctacttcttgtgtatcttgcattggatatgccaaagttctttccttttttgtgttttctttcttttaataatataaactccaaaatagattgtttgattcttttcatgtggaacatttaaaatattatttgtgctttatta

SEQ ID NO: 31188 - DNA, 2023 bp, Homo sapiens
agcctgccgcttccggctctggcggggggggcacgtgccccgtcccgttgccccggcgaccgcggcggtttgttctcaggccccggcctttctcaccgtgcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaa

SEQ ID NO: 31189 - DNA, 2166 bp, Homo sapiens
atgtgaggaaagagcgcggcccctgcgcccctgcggcacacgctgtgaaacaaccctcctgggtgtggctcggcttctcggctgtccaaacagcctgaagaaaagccccatgcatgctctggcctcgtctcagcagttccaggccatccttctcgaggggcgggagctgaccggcatgaaccggccgcagcgagccgctcgaggcctggttggcttcgagctcaggagggacgcacgagcctgccgcttccggctctggcggggggggcacgtgccccgtcccgttgccccggcgaccgcggcggtttgttctcaggccccggcctttctcaccgtgcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaa

SEQ ID NO: 31190 - DNA, 1679 bp, Homo sapiens
agcctgccgcttccggctctggcggggggggcacgtgccccgtcccgttgccccggcgaccgcggcggtttgttctcaggccccggcctttctcaccgtgcgacgccccaacccgccgctccgccgcggtggtacgctccaggccgccaggccgcgaggcccaccgagcggacgccagtggatgacccgcggcgggggaggaggagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaa

SEQ ID NO: 31191 - DNA, 1882 bp, Homo sapiens
ctcaggccccggcctttctcaccgtgcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaatatcctggcgactcagagggcagagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaa

SEQ ID NO: 31192 - DNA, 615 bp, Homo sapiens
gaccgcggcggtttgttctcaggccccggcctttctcaccgtgcgacgccccaacccgccgctccgccgcggtggtacgctccaggccgccaggccgcgaggcccaccgagcggacgccagtggatgacccgcggcgggggaggaggagagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaaca

SEQ ID NO: 31193 - DNA, 1669 bp, Homo sapiens
acgctcctttgcccctttctgcccctcagcacccccaagaccctgaggccgctaccccccttcccgccgcccccagggacccccttggcaattggggaggccccttccccgacgccaacaacacgcctttctccctcacccagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttga

SEQ ID NO: 31194 - DNA, 1689 bp, Homo sapiens
ccgtcccgttgccccggcgaccgcggcggtttgttctcaggccccggcctttctcaccgtgcgacgccccaacccgccgctccgccgcggtggtacgctccaggccgccaggccgcgaggcccaccgagcggacgccagtggatgacccgcggcgggggaggaggagttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtaggg

SEQ ID NO: 31195 - DNA, 1690 bp, Homo sapiens
ctttctcaccgtgcgacgccccaacccgccgctccgccgcggtggtacgctccaggccgccaggccgcgaggcccaccgagcggacgccagtggatgacccgcggcgggggaggaggaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaa

SEQ ID NO: 31196 - DNA, 1978 bp, Homo sapiens
ggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaa

SEQ ID NO: 31197 - DNA, 1974 bp, Homo sapiens
ccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaa

SEQ ID NO: 31198 - DNA, 1233 bp, Homo sapiens
gacaaagacctgcgccggcgcgcgggactctgcgtgaggcgagcgccggggctcccggagcggatccctacctgtttcaaggacctgccagtctgagaagcttcttgtcataaggccatccaggggccacgcacccctaccttgccagcctccagcatgcaggataccgtaacgacatcagcattgttggaccccagccactcctcagtctccacccaggacaattcctccactggaggacacacttcaagcacaagcccacagctctcaaagccttcaatcacaccagtccctgcaaagtccaggaacccacatcccagggccaatatccgtcggatgcgccggatcattgctgaggatcctgagtggtcactggccatcgtgcccctcctcacagagctctgcattcagcacattatcaggaacttccagaaaaaccctatcctgaagcagatgctcccggaacaccagcagaaggtcctgaaccacctgtcccctgacctaccactggctgtgaccgccaacctgatagacagtgagaactactggctccgctgctgcatgcatcgctggcccgtgtgccacgtggcccaccatggcggcagctggaaacgcatgttcttcgagcggcacctggagaacctgctaaagcactttatcccaggcaccacagaccctgcggtgatcctcgacctgctgccgctctgccggaattacgtgcgcagggtccacgtcgatcagttccttccgccggtgcagctcccggcccagctccggccgggcgaccagtccgactcaggcagcgagggagagatggaggagcccaccgttgaccactaccaactgggcgatctggtagctggcctgagccacctggaggagctggacctggtgtacgatgtcaaggactgcggcatgaatttcgagtggaatctcttcctcttcacctaccgtgactgcctctccttggcagccgccatcaaggcatgccacaccctcaaggacggtgggaagcagctcctggaaggcatgtcagacaacaagaccctcctggaatttgacttgcgcctgtcagatgtggcccaggaaagcgagtacctcattggccaggccctctacgcaaaccgagaagcagcccgccagcgggccctgaatcccagccacttcatgtcaaccataactgccaatggccctgagaactctgtgggataaaatgacctgacttggatcatg

SEQ ID NO: 31199 - DNA, 616 bp, Homo sapiens
cgcatgttcttcgagcggcacctggagaacctgctaaagcactttatcccaggcaccacagaccctgcggtgatcctcgacctgctgccgctctgccggaattacgtgcgcagggtccacgtcgatcagttccttccgccggtgcagctcccggcccagctccggccgggcgaccagtccgactcaggcagcgagggagagatggaggagcccaccgttgaccactaccaactgggcgatctggtagctggcctgagccacctggaggagctggacctggtgtacgatgtcaaggactgcggcatgaatttcgagtggaatctcttcctcttcacctaccgtgactgcctctccttggcagccgccatcaaggcatgccacaccctcaaggacggtgggaagcagctcctggaaggcatgtcagacaacaagaccctcctggaatttgacttgcgcctgtcagatgtggcccaggaaagcgagtacctcattggccaggccctctacgcaaaccgagaagcagcccgccagcgggccctgaatcccagccacttcatgtcaaccataactgccaatggccctgagaactctgtgggataaaatgacctgacttgga

SEQ ID NO: 31200 - DNA, 3067 bp, Homo sapiens
gtgaggcgagcgccggggctcccggagcggatccctacctgtttcaaggacctgccagtctgagaagcttcttgtcataaggccatccaggggccacgcacccctaccttgccagcctccagcatgcaggataccgtaacgacatcagcattgttggaccccagccactcctcagtctccacccaggacaattcctccactggaggacacacttcaagcacaagcccacagctctcaaagccttcaatcacaccagtccctgcaaagtccaggaacccacatcccagggccaatatccgtcggatgcgccggatcattgctgaggatcctgagtggtcactggccatcgtgcccctcctcacagagctctgcattcagcacattatcaggaacttccagaaaaaccctatcctgaagcagatgctcccggaacaccagcagaaggtcctgaaccacctgtcccctgacctaccactggctgtgaccgccaacctgatagacagtgagaactactggctccgctgctgcatgcatcgctggcccgtgtgccacgtggcccaccatggcggcagctggaaacgcatgttcttcgagcggcacctggagaacctgctaaagcactttatcccaggcaccacagaccctgcggtgatcctcgacctgctgccgctctgccggaattacgtgcgcagggtccacgtcgatcagttccttccgccggtgcagctcccggcccagctccggccgggcgaccagtccgactcaggcagcgagggagagatggaggagcccaccgttgaccactaccaactgggcgatctggtagctggcctgagccacctggaggagctggacctggtgtacgatgtcaaggactgcggcatgaatttcgagtggaatctcttcctcttcacctaccgtgactgcctctccttggcagccgccatcaaggcatgccacaccctcaagatcttcaagctgacccgaagcaaggtggatgatgacaaggcacgcatcataattcgaagccttctggaccacccagtcctcgaggagctggacttgtcacaaaacctcattggagaccgtggtgcacgaggtgctgccaagctgctgagccacagccgcctgcgtgtgctcaacctggctaacaaccaggtgcgtgcacccggtgcccagtccctggctcacgctctggcacacaacaccaacctcatttccctcaacctacgtctcaactgcatcgaggatgagggtggccaggctcttgcccatgccttgcagaccaacaagtgcctcaccacgctgcacctcggtggcaatgagctgtctgagcccaccgccacactcctgtcacaggtgctcgccatcaacaccacactcaccagcatcaacctgtcctgcaaccacatcgggctggacggtgggaagcagctcctggaaggcatgtcagacaacaagaccctcctggaatttgacttgcgcctgtcagatgtggcccaggaaagcgagtacctcattggccaggccctctacgcaaaccgagaagcagcccgccagcgggccctgaatcccagccacttcatgtcaaccataactgccaatggccctgagaactctgtgggataaaatgacctgacttggatcatggccccagccccatccctcatttcatacccctgccatgcctgctgcagagtatcacactggttcagagggagcggggagggggactgtgaataaccttggagtgatcaagggttgtatggatggagacatgaggcagggaagggagcctggcatgggggaagaaagggtatgcagtagggacccagcctttgtgcccagggaaaggatattactggacacccacaaatgaccaacttctttcaggaacagggaagtcagagaggtgtctgagggactgtgcctgccagattctcccgttggggctgcctgcctccctgactccccaccattttcttctctaccaaacagatccttgatcttcaaacacacacacacacacacacacacacacacacacacacacacacacaccctctggctacagcagggctatgcctggctctctctgccaccctcatccctgtagatgcatttccctgttgcttgactctgctttaagtgatccagttctacaggccacgccatcccctagttccccaactcccaacctgggaaggggacaatgagctgacaccaggggctcagacccagtggactcctctggggaggcaactgtagatgacaacttccagggaaggatgacacaatccctgccacccaccccagagagcttccctgggagggagggaaagaagtgccacactgggacaggaagtcagtgagtcatccacgactttattatccaccagtttgatttgtacaatctttgcgcttaaatccacgacaaaaaggccacagtgtgatgcacccaattgacagagacctgtcttctccccagccaggcccagcccaccccacaagcccttgtccccaggacacatggagccttccaggtgccctacatgagtcccccatcactctgtagctgtccaccctggggccacacctacaggaatcacatcagcccccagggccacaagagacctagctgactgattcaggctgagcgccattgcccatcctccttgggctgattcattggcccagagcctccagaactgtgtccccaaagggcaggtcatgggctacaaccccagtccaggagtgcctgctctccagggactccttccgctaagcaggcgctgagcagagcaccaaagggggcttgggagtgactgcatgtgtgtgcctgtctaggcaacctagagtctgtctgtgcctgacaccctctgacagttccggagtgcaaacgtgtaggtgtgagggtgtgtgtgtgtgtgtgtgtgtgtatagccacagctgctagcagaagttctaattagagaaacaagaacattcagtgtaaagtttaattttagagattaattaattttctggttttcattttccctggcaatcagtaaagctaccaagaaaa

SEQ ID NO: 31201 - DNA, 769 bp, Homo sapiens
cgaggcgcaggtgggagacttccgccctcgcgggactggctagggcgtttgaccgccggcggtgaaggggaggcggtgggcgtcttggagaacagagcgagatggagaagcgaggccgaggcgtgaagtcgagccccatccagaccccgaaccagacccctcagcaggctccggtgacgcctaggaaagaaaggaggcctagcatgttcgagaaggaggcatatacacagattttaagagaaagactgagagagtcaattcacaatgttcagtatgtggagcctccttttgatgactcaattgctgatataggtaaagaatggaagagtgccctggcaaaattaaagtttgctaattcatatagaatggagccattgaagaaattccaagctcattcagtagaaactaaagtccagcagatactaacagaaagtcttaaagatgtcaaatatgatgataaagtattctctcacttgtcacttgaattggcagaccgcatactgttagcagtcaaagaatttgggtaccaccgttataagttcattataaaagtattatttattcaaaagactggccaagcaataaatattgccagcagatggatctgggacattgcatgggacagctgggtcgcagctaaacacgaagcagaatcctacgtggcactggtcttggtgtttgccctttattatgaatagctcattacaggtactaaggattgtttacttccgaacttttcaaaaataaatgaaatttacatatttgtaaa

SEQ ID NO: 31202 - DNA, 763 bp, Homo sapiens
caggtccatggccagcaggcctctgcccccgggacgccaggaggaggagaatgccaaagactccgggcggaaaccctcaccggtgcggccccgaggctgcctgcccagcattgatgaggcccgaccggcaggtccaggtccagccccggcctcgcgccggggctccatgctgggcctggccgcgtccttctcccgccgcaactcgctggtcgggccaggcgcgggtcctgggggtcagcggccatccctgggcccggtgccccctctgggctcaagggtcagcttctcagggttgcccctggcgcccgcccgttgggtggcgccctcctaccgcacggagccagtgcccggggagcgctgggaggctgcgcgtgcacagcgtgccctggaggcggcgctggccgcagggctgcacgacgcgtgctactccagcgacgaggccgcgcggctggtgcgggagctctgcgagcaggtgcacgttcgcctgcgcgagctcagcccgccacgctacaagctggtatgcagtgtggtgctggggccgcgcgcgggccagggcgttcacgtggtcagccgtgcgctctgggacgtggcgcgcgatgggctggcctcggtctcctacaccaacacctcgctcttcgcggtggccacggtccacgggctctactgcgagtgagggggagtccaattctgcaaaattgtttattatcctaggaggaggcccccctggggctcacatcccaataaataagtgtctgacaataaa

SEQ ID NO: 31203 - DNA, 1262 bp, Homo sapiens
agaactgattctggaggaagtgggatcagaggccaaaggcagaaggtggaagggggcttcatgagtcatctgccctcagcctgggccaggtgtaggggagatctttgtgccagccaccctagagtagatctgggtggaagatgactggattcaacacccccagggctggaaggatctgtggggttgaaggagctgagtctgtcagtccttcctggttaggggttggaggctctgcctccacagtccaggctgaggcagaggcctgcctctccttccagagaagtcgggtggaagggagaaatggcagtctctaagactccgagcgtacctggctaacttccatagtgcccagagaaggagctcagtcggcaaggactagccgaggatcccagtcctagcagcctcctgtcccctgctcatgtgtctaacagcctttaaccttctcagcacctaggaacccaggcagcctgggactatctgatccacttgttctaaaacacagcaggtccatggccagcaggcctctgcccccgggacgccaggaggaggagaatgccaaagactccgggcggaaaccctcaccggtgcggccccgaggctgcctgcccagcattgatgaggcccgaccggcaggtccaggtccagccccggcctcgcgccggggctccatgctgggcctggccgcgtccttctcccgccgcaactcgctggtcgggccaggcgcgggtcctgggggtcagcggccatccctgggcccggtgccccctctgggctcaagggtcagcttctcagggttgcccctggcgcccgcccgttgggtggcgccctcctaccgcacggagccagtgcccggggagcgctgggaggctgcgcgtgcacagcgtgccctggaggcggcgctggccgcagggctgcacgacgcgtgctactccagcgacgaggccgcgcggctggtgcgggagctctgcgagcaggtgcacgttcgcctgcgcgagctcagcccgccacgctacaagctggtatgcagtgtggtgctggggccgcgcgcgggccagggcgttcacgtggtcagccgtgcgctctgggacgtggcgcgcgatgggctggcctcggtctcctacaccaacacctcgctcttcgcggtggccacggtccacgggctctactgcgagtgagggggagtccaattctgcaaaattgtttattatcctaggaggaggcccccctggggctcacatcccaataaataagtgtctgacaat

SEQ ID NO: 31204 - DNA, 3075 bp, Homo sapiens
tcgcagttaccaccaaacccaggaggagactctccctggaaaacttcccttccctttcggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagaaaacaggtgtctagtcacattcaggttcttgccagaaggaaatctcgtgattttcattccaagctaaaggtaacaagcatggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtggg

SEQ ID NO: 31205 - DNA, 9430 bp, Homo sapiens
ttccgaacattcttagcatcgctcgcgccgcgccgcgccgcctgagccgagccgagcctctgctgccgccgccgcggccccgccgcccgccgcgggcgcccaccaagcactttgcagactcgcttccaccctgcgggccattccgcgcggcggggcccgggcccggggcggccgcgtccaggcacaggccatgcagtgacgcccccccacccctccacctttgcccggagcgcgggcagcagcccagcgcgccagccggccccggggcaggagcggtgctaggcaggggtggggtggccgggcccagggaccgggagccggggagggagccgggcaccgagcagagggcgggggaagcggcgccgaagtttgcctcggactcgccgggcgctgcggtggctccctgggccgaggactgttgctgccgctgccgccgccgcttcattgcacattcaagtggaaaattttcaggagtcagcagaaacattgtgtccaaaaaagactgagtcgcagttaccaccaaacccaggaggagactctccctggaaaacttcccttccctttcggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagaaaacaggtgtctagtcacattcaggttcttgccagaaggaaatctcgtgattttcattccaagctaaaggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcgtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtgggaaacagcaaaacactaagcctgacctctcccaaattgggaagaccagaggagaaagtgcaaaactgtccccatttggaatgcccattccttctagaaaccagttggacagtgctcctctgcccttcataaacagactactgttgggtccctgattccaggctggcctgtgaaggattgccccaggtgtcccctttcacggttgtcacatttacagtgacttctgttgaacacccctcttagggatgtttcttttgctcttatttcctgcatctttccttaagggaagccccatcctctcccaggaccaggagtttatgaccaggcgagcacaaatggctaaaagccaagctgtcctagaacttcagtgggagagctgtctggttcatattctacccaggaatggtacttttcagtgcagccaggagggctcttgggatttcctttccaaagcacaaaaatactgggacccaagaagaacagctagaggacaactctgttggcacagagacggggacagcccagtctgctgacctcacagggtcagctgggcccccctggtgcttcaccacctgcatcctcttgctcagaatgcctttgcagttgagttttctgggtttctatgattgaccttgaggtttactccttgctcttacaacatttctaaggatttttaaaagtttacttcttgtcttgttcttctaaagctttctccaggacagatattttccctgtcttaaccactggtccagtcatcccagtgggcttctctttgtctctcccagattagacctttgggtgagattggcatcacaacatctaatctgagtctgtcttttgtccttcattctgtatggcagtctccctttgttataaaagctttctaaagcatactaaagaagccttcccagagccccgtcttgcttctcttccaggtgctctatcccctcgagaccctctggtgccaggcttgcttcacggccatcttgtgttgtcactgcagagtttggaggccagttttccacagcctaaacagggaggagctgcagaatggggctctggtctctgggcattcatttccctcatagaggctgagaataaaacaaggacttattcacacatgttctagaaccccagaatggcccaagttacctgagaccagggtttctcaaccttgacaccattgacattttggactgggtaattctttgttctgcagagctgtcctttgcactgtaggagatttactaatatccctggcctctacccagtagtaccactagcacctattccccacccagcgtgtctccagatattgtcaaatatcccatcgggtgcaaaatgatccctggtcaagatctgttgcccaagatgttacaggtcacaatgaccacatttgaaattgttttccctttcattttaccctgtgaaagcatctctcctagagccttgcaagaggcaggtgacattgtgtccatatttcttcctgtttcagaacttctgtttcacaacaatttctctctcgctacaagtattctttcactcagcactggggaagttgggaacagctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccagctggttagtgacagaaaaagcgtgagagttgtctaggattcctgccactttggtccctggcctctcctgggggaggctgctgttcttaggtgctctaagcttaatccctcagaatgtgtggacaggtcagcttagaagagatggggagattcaggatccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccgtaagcagtgccttagtaataccttagtcatgccgccagccttttcttacaccaattcctaatgttcatttacgaattggcccaatattggaaacaaaacaagcaaaaattgtcttcatttttgttttgtaagcccattttttctccagttctataggaaactgactgcttggtgtaaaatccgaaactggacacaagtcagttctttcaccacactcaaatgtatataccaaaacaaaaggttgcaacttcatagtttactatgaaaagcaaattgtactttttaatgttgccttttaaattcatgaccaaatacttagctatttgtgaatcttctgcactctagcatgaaagtgcctttggtttgagattccagcttagaaaagtgctgccataataacgataatttgtagagagaccaaaaatattttgagatcaccgtaatgcctttggtttaccgggatgagtaaccaaccacaggcctctgttcacaagagcacgacgtggtccccgcctgctgctagtctgtctgccactgggggcctcccaacatccatagcacacttcagcggaaggaccccagaaactgttgtgtttgtgtgtgctgatgacctagtgtgtcatttcacctcgtcacccagccctgcgtccggatgaggggacttctgcacaaatgacagaatctcggctggtggacagatactacagctttctcctcctccttgtgttcgtgttcagtctctgtggagactttcttttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgtaaaaaaaaaaaaatgtattctagcttttgcggtacatatgtgtgataactttaatacccatgacagttaagtgcaattatttcatcactctaaaaatgctatttttgtgtcagttcctgcaggtgttttcatgtctttgcaaagtgacacattttgatgccttcttgataaagtggtagacattttgtagctttctagaaactttgtattcatacggtatcaatgaaaaataaagaaaatgaaagtgtgggtcaccttttttatctgc

SEQ ID NO: 31206 - DNA, 8156 bp, Homo sapiens
agggagtgtggtggcattgctctgcagagacatgaacagctccctgggagacactgctggggaaagatgagtcgagtctacggttttttctcatcctcctgtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagaaaacaggtgtctagtcacattcaggttcttgccagaaggaaatctcgtgattttcattccaagctaaaggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcgtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtgggaaacagcaaaacactaagcctgacctctcccaaattgggaagaccagaggagaaagtgcaaaactgtccccatttggaatgcccattccttctagaaaccagttggacagtgctcctctgcccttcataaacagactactgttgggtccctgattccaggctggcctgtgaaggattgccccaggtgtcccctttcacggttgtcacatttacagtgacttctgttgaacacccctcttagggatgtttcttttgctcttatttcctgcatctttccttaagggaagccccatcctctcccaggaccaggagtttatgaccaggcgagcacaaatggctaaaagccaagctgtcctagaacttcagtgggagagctgtctggttcatattctacccaggaatggtacttttcagtgcagccaggagggctcttgggatttcctttccaaagcacaaaaatactgggacccaagaagaacagctagaggacaactctgttggcacagagacggggacagcccagtctgctgacctcacagggtcagctgggcccccctggtgcttcaccacctgcatcctcttgctcagaatgcctttgcagttgagttttctgggtttctatgattgaccttgaggtttactccttgctcttacaacatttctaaggatttttaaaagtttacttcttgtcttgttcttctaaagctttctccaggacagatattttccctgtcttaaccactggtccagtcatcccagtgggcttctctttgtctctcccagattagacctttgggtgagattggcatcacaacatctaatctgagtctgtcttttgtccttcattctgtatggcagtctccctttgttataaaagctttctaaagcatactaaagaagccttcccagagccccgtcttgcttctcttccaggtgctctatcccctcgagaccctctggtgccaggcttgcttcacggccatcttgtgttgtcactgcagagtttggaggccagttttccacagcctaaacagggaggagctgcagaatggggctctggtctctgggcattcatttccctcatagaggctgagaataaaacaaggacttattcacacatgttctagaaccccagaatggcccaagttacctgagaccagggtttctcaaccttgacaccattgacattttggactgggtaattctttgttctgcagagctgtcctttgcactgtaggagatttactaatatccctggcctctacccagtagtaccactagcacctattccccacccagcgtgtctccagatattgtcaaatatcccatcgggtgcaaaatgatccctggtcaagatctgttgcccaagatgttacaggtcacaatgaccacatttgaaattgttttccctttcattttaccctgtgaaagcatctctcctagagccttgcaagaggcaggtgacattgtgtccatatttcttcctgtttcagaacttctgtttcacaacaatttctctctcgctacaagtattctttcactcagcactggggaagttgggaacagctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccagctggttagtgacagaaaaagcgtgagagttgtctaggattcctgccactttggtccctggcctctcctgggggaggctgctgttcttaggtgctctaagcttaatccctcagaatgtgtggacaggtcagcttagaagagatggggagattcaggatccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccgtaagcagtgccttagtaataccttagtcatgccgccagccttttcttacaccaattcctaatgttcatttacgaattggcccaatattggaaacaaaacaagcaaaaattgtcttcatttttgttttgtaagcccattttttctccagttctataggaaactgactgcttggtgtaaaatccgaaactggacacaagtcagttctttcaccacactcaaatgtatataccaaaacaaaaggttgcaacttcatagtttactatgaaaagcaaattgtactttttaatgttgccttttaaattcatgaccaaatacttagctatttgtgaatcttctgcactctagcatgaaagtgcctttggtttgagattccagcttagaaaagtgctgccataataacgataatttgtagagagaccaaaaatattttgagatcaccgtaatgcctttggtttaccgggatgagtaaccaaccacaggcctctgttcacaagagcacgacgtggtccccgcctgctgctagtctgtctgccactgggggcctcccaacatccatagcacacttcagcggaaggaccccagaaactgttgtgtttgtgtgtgctgatgacctagtgtgtcatttcacctcgtcacccagccctgcgtccggatgaggggacttctgcacaaatgacagaatctcggctggtggacagatactacagctttctcctcctccttgtgttcgtgttcagtctctgtggagactttcttttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatg

SEQ ID NO: 31207 - DNA, 8477 bp, Homo sapiens
tgagaggcttcacattctgttggaaaatggatttaatccctaaaaaaagccttgccccattgggtcttcccagtaaatgttgagaggtacggtaggttgagtgtggtttagccttctggctgtgttatttatccatgcatgtttgctttttttggcctattttgtggctctgtattttagtccatgtgctcgtggctgtgcctgtgtaacctgcctggtagccatgcgttatgtattaagttggtgtgtcactgtcaccttcaaggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcgtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtgggaaacagcaaaacactaagcctgacctctcccaaattgggaagaccagaggagaaagtgcaaaactgtccccatttggaatgcccattccttctagaaaccagttggacagtgctcctctgcccttcataaacagactactgttgggtccctgattccaggctggcctgtgaaggattgccccaggtgtcccctttcacggttgtcacatttacagtgacttctgttgaacacccctcttagggatgtttcttttgctcttatttcctgcatctttccttaagggaagccccatcctctcccaggaccaggagtttatgaccaggcgagcacaaatggctaaaagccaagctgtcctagaacttcagtgggagagctgtctggttcatattctacccaggaatggtacttttcagtgcagccaggagggctcttgggatttcctttccaaagcacaaaaatactgggacccaagaagaacagctagaggacaactctgttggcacagagacggggacagcccagtctgctgacctcacagggtcagctgggcccccctggtgcttcaccacctgcatcctcttgctcagaatgcctttgcagttgagttttctgggtttctatgattgaccttgaggtttactccttgctcttacaacatttctaaggatttttaaaagtttacttcttgtcttgttcttctaaagctttctccaggacagatattttccctgtcttaaccactggtccagtcatcccagtgggcttctctttgtctctcccagattagacctttgggtgagattggcatcacaacatctaatctgagtctgtcttttgtccttcattctgtatggcagtctccctttgttataaaagctttctaaagcatactaaagaagccttcccagagccccgtcttgcttctcttccaggtgctctatcccctcgagaccctctggtgccaggcttgcttcacggccatcttgtgttgtcactgcagagtttggaggccagttttccacagcctaaacagggaggagctgcagaatggggctctggtctctgggcattcatttccctcatagaggctgagaataaaacaaggacttattcacacatgttctagaaccccagaatggcccaagttacctgagaccagggtttctcaaccttgacaccattgacattttggactgggtaattctttgttctgcagagctgtcctttgcactgtaggagatttactaatatccctggcctctacccagtagtaccactagcacctattccccacccagcgtgtctccagatattgtcaaatatcccatcgggtgcaaaatgatccctggtcaagatctgttgcccaagatgttacaggtcacaatgaccacatttgaaattgttttccctttcattttaccctgtgaaagcatctctcctagagccttgcaagaggcaggtgacattgtgtccatatttcttcctgtttcagaacttctgtttcacaacaatttctctctcgctacaagtattctttcactcagcactggggaagttgggaacagctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccagctggttagtgacagaaaaagcgtgagagttgtctaggattcctgccactttggtccctggcctctcctgggggaggctgctgttcttaggtgctctaagcttaatccctcagaatgtgtggacaggtcagcttagaagagatggggagattcaggatccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccgtaagcagtgccttagtaataccttagtcatgccgccagccttttcttacaccaattcctaatgttcatttacgaattggcccaatattggaaacaaaacaagcaaaaattgtcttcatttttgttttgtaagcccattttttctccagttctataggaaactgactgcttggtgtaaaatccgaaactggacacaagtcagttctttcaccacactcaaatgtatataccaaaacaaaaggttgcaacttcatagtttactatgaaaagcaaattgtactttttaatgttgccttttaaattcatgaccaaatacttagctatttgtgaatcttctgcactctagcatgaaagtgcctttggtttgagattccagcttagaaaagtgctgccataataacgataatttgtagagagaccaaaaatattttgagatcaccgtaatgcctttggtttaccgggatgagtaaccaaccacaggcctctgttcacaagagcacgacgtggtccccgcctgctgctagtctgtctgccactgggggcctcccaacatccatagcacacttcagcggaaggaccccagaaactgttgtgtttgtgtgtgctgatgacctagtgtgtcatttcacctcgtcacccagccctgcgtccggatgaggggacttctgcacaaatgacagaatctcggctggtggacagatactacagctttctcctcctccttgtgttcgtgttcagtctctgtggagactttcttttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgt

SEQ ID NO: 31208 - DNA, 477 bp, Homo sapiens
gtgacgcccccccacccctccacctttgcccggagcgcgggcagcagcccagcgcgccagccggccccggggcaggagcggtgctaggcaggggtggggtggccgggcccagggaccgggagccggggagggagccgggcaccgagcagagggcgggggaagcggcgccgaagtttgcctcggactcgccgggcgctgcggtggctccctgggccgaggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggta

SEQ ID NO: 31209 - DNA, 2544 bp, Homo sapiens
ggccgcgtccaggcacaggccatgcagtgacgcccccccacccctccacctttgcccggagcgcgggcagcagcccagcgcgccagccggccccggggcaggagcggtgctaggcaggggtggggtggccgggcccagggaccgggagccggggagggagccgggcaccgagcagagggcgggggaagcggcgccgaagtttgcctcggactcgccgggcgctgcggtggctccctgggccgaggactgttgctgccgctgccgccgccgcttcattgcacattcaagtggaaaattttcaggagtcagcagaaacattgtgtccaaaaaagactgagtcgcagttaccaccaaacccaggaggagactctccctggaaaacttcccttccctttcggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagaaaacaggtgtctagtcacattcaggttcttgccagaaggaaatctcgtgattttcattccaagctaaaggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcgtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatg

SEQ ID NO: 31210 - DNA, 2159 bp, Homo sapiens
cccacttttcccaaacaaagctcccggcaactttctccctcgcagcgccccgcccgcccgcggctccccagccccaggccgggaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttacc

SEQ ID NO: 31211 - DNA, 2440 bp, Homo sapiens
cttctcctccctcagactcaggagtccagaccccagccccttctccctcacacccaggagtccaggcctccagcccccgctccctcagacccaggagtccaggccccagatcctcctccctcagtcctaggagtccgggccccagcccctcctccctcagactcaggagttcaggccccagatcctcctccctcagacccaggaataccccccagctcctcttccctcagacccaggagtccaggtccccagcccctcctccctcagacccagtggtccagagtcccagccctctcagcttcaagtcccttgagggtggggtttgggggaagcttgctgagttctgtgttcctccaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggtggtccaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttacc

SEQ ID NO: 31212 - DNA, 1444 bp, Homo sapiens
aaagctcccggcaactttctccctcgcagcgccccgcccgcccgcggctccccagccccaggccgggaggtcggaatgaactgatcgcccgctacatcaagctgagaacggggaagacccgaactcgaaaacaggtttctagtcacatccaggttttggcccgaaggaaatcaagggaaatccagtccaagttgaaggctctgaacgtggaccaggtttccaaggacaaggctttccagacaatggcaaccatgtcctctgcccagctcatctccgcgccttctctgcaggccaaactgggtcccactggtcctcaggtggtccaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctg

SEQ ID NO: 31213 - DNA, 2141 bp, Homo sapiens
aggccgggaggtaggaaggcgccggcgggagtcggggatcctgctttggggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggctctgaacgtggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttaccaaaaa

SEQ ID NO: 31214 - DNA, 2191 bp, Homo sapiens
tgatggcagggcgcccctgtcccccagcttgtggttctgtgggtctctcctggtctcggcctcagctgctgccctgagtctctgtccctgccctttctaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggctctgaacgtggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttaccaaaaa

SEQ ID NO: 31215 - DNA, 2167 bp, Homo sapiens
cgcccgcccgcggctccccagccccaggccgggaggtaggaaggcgccggcgggagtcggggatcctgctttggggtgtgcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggtggtccaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttaccaaaaa

SEQ ID NO: 31216 - DNA, 2983 bp, Homo sapiens
acaaactttccgtcccgctcgctccctcctccgcgctcggcgcctcccgctccagcccggctcattccgcacattccggccagccccctccccacgaccccccttccccggccccccttgcggctccctcgggcccggcggagcggcccggccggagcgcccccgcgagctcggaccaggctcagccgcccagtgggctcaggcccagagcccagagcaaccagcacaatagcgtccaacagctggaacgccagcagcagccccggggaggcccgggaggatgggcccgagggcctggacaaggggctggacaacgatgcggagggcgtgtggagcccggacatcgagcagagcttccaggaggccctggccatctacccgccctgcggccggcggaagatcatcctgtcagacgagggcaagatgtacggccgaaatgagttgattgcacgctatattaaactgaggacggggaagactcggacgagaaaacaggtgtccagccacatacaggttctagctcggaagaaggtgcgggagtaccaggttggcatcaaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgcctcctcccggctgcggctcctggagtattcagccttcatggaggtgcagcgagaccctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccaggagggcccgggagccttctatggggtcagctctcagtacagctctgctgatagcatgaccatcagcgtctccaccaaggtgtgctcctttggcaaacaggtggtagagaaggtggagactgagtatgccaggctggagaacgggcgctttgtgtaccgtatccaccgctcgcccatgtgcgagtacatgatcaacttcatccacaagctgaagcacctgcccgagaagtacatgatgaacagcgtgctggagaacttcaccatcctgcaggtggtcacgagccgggactcccaggagaccctgcttgtcattgcttttgtcttcgaagtctccaccagtgagcacggggcccagcaccatgtctacaagctcgtcaaagactagggtgccctctgcgcctccttaaggatgcagggtgagcatctcctctccacacctgcctggcacccctgggggggtccaggattgaggattcatctacctgccaggcctcaggcccaggacccaggaggcctccccacctaccccagcacacacactccctgccactgttctgcgctttaattgtgggagaagagaggagaggagggctcagcggtggggcagcctgtccggggcgctgacccaccatcaccctgctctgcccagcctcgcgtgacctcagagaggtggggataggggacaccttcagcctccagcatgtgtggccactgtacccccacccacccttgggggagcatgatgggcaggtgagggcaggatggagaccaagggagtcagtgagcagaggccctgggagtgtccggttggggttggactgaggacagaggggcccacacttccttgcccctttgtgtcccaggcctggtgcccagactccttgcatggcttgtgtggtcctcagactccgcacagcgagcgtaggtctctgggtttcagatgaagtgcccaggctccaggaagttgagggacccacaggagaggtgggcagagctggagttctcatccagggctgcttgtccccagagcccaggtttatactacctccctggggcgggggctggccgcagggtaggggagaggctctgcagtgtggagtggagcctcatcgaggggcgctgggttaggggagcacctgtttcagactgggcatgaagaagggagcacagcagctactagaccccattagcacctcattagcccacaagccagccaggggccccaggaagatggggcaccccccagcaccctccagattgagagcaaggtagaggaaggagtcccagcctctgggcagaccagaggcccagagggagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaaaaaaaaattaaagttatttgtttgtgggtcagtcatgtaa

SEQ ID NO: 31217 - DNA, 2989 bp, Homo sapiens
tcctcaacacaaactttccgtcccgctcgctccctcctccgcgctcggcgcctcccgctccagcccggctcattccgcacattccggccagccccctccccacgaccccccttccccggccccccttgcggctccctcgggcccggcggagcggcccggccggagcgcccccgcgagctcggaccaggctcagccgcccagtgggctcaggcccagagcccagagcaaccagcacaatagcgtccaacagctggaacgccagcagcagccccggggaggcccgggaggatgggcccgagggcctggacaaggggctggacaacgatgcggagggcgtgtggagcccggacatcgagcagagcttccaggaggccctggccatctacccgccctgcggccggcggaagatcatcctgtcagacgagggcaagatgtacggccgaaatgagttgattgcacgctatattaaactgaggacggggaagactcggacgagaaaacaggtctctagccacttgcaagttctagccaggcggaaatctcgggagattcagtctaagctgaagtcctctccccaggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgcctcctcccggctgcggctcctggagtattcagccttcatggaggtgcagcgagaccctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccaggagggcccgggagccttctatggggtcagctctcagtacagctctgctgatagcatgaccatcagcgtctccaccaaggtgtgctcctttggcaaacaggtggtagagaaggtggagactgagtatgccaggctggagaacgggcgctttgtgtaccgtatccaccgctcgcccatgtgcgagtacatgatcaacttcatccacaagctgaagcacctgcccgagaagtacatgatgaacagcgtgctggagaacttcaccatcctgcaggtggtcacgagccgggactcccaggagaccctgcttgtcattgcttttgtcttcgaagtctccaccagtgagcacggggcccagcaccatgtctacaagctcgtcaaagactagggtgccctctgcgcctccttaaggatgcagggtgagcatctcctctccacacctgcctggcacccctgggggggtccaggattgaggattcatctacctgccaggcctcaggcccaggacccaggaggcctccccacctaccccagcacacacactccctgccactgttctgcgctttaattgtgggagaagagaggagaggagggctcagcggtggggcagcctgtccggggcgctgacccaccatcaccctgctctgcccagcctcgcgtgacctcagagaggtggggataggggacaccttcagcctccagcatgtgtggccactgtacccccacccacccttgggggagcatgatgggcaggtgagggcaggatggagaccaagggagtcagtgagcagaggccctgggagtgtccggttggggttggactgaggacagaggggcccacacttccttgcccctttgtgtcccaggcctggtgcccagactccttgcatggcttgtgtggtcctcagactccgcacagcgagcgtaggtctctgggtttcagatgaagtgcccaggctccaggaagttgagggacccacaggagaggtgggcagagctggagttctcatccagggctgcttgtccccagagcccaggtttatactacctccctggggcgggggctggccgcagggtaggggagaggctctgcagtgtggagtggagcctcatcgaggggcgctgggttaggggagcacctgtttcagactgggcatgaagaagggagcacagcagctactagaccccattagcacctcattagcccacaagccagccaggggccccaggaagatggggcaccccccagcaccctccagattgagagcaaggtagaggaaggagtcccagcctctgggcagaccagaggcccagagggagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaaaaaaaaattaaagttatttgtttgtgggtcagtcatgt

SEQ ID NO: 31218 - DNA, 1637 bp, Homo sapiens
gtggccccgccgccactccctccggctccctccctcccgccgcggcgcgcatctcattccagccctcattccgcgcattccagcgtcctcctcgcacactcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaagttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgta

SEQ ID NO: 31219 - DNA, 1690 bp, Homo sapiens
gtcctcctcgcacactcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgtattttcaga

SEQ ID NO: 31220 - DNA, 1396 bp, Homo sapiens
tctgcgcgctgacgccctgtcgtccccgcagaacgatcgccgcggccggaagagttggcgctcggggcggactccttggaactggcttagcgcacccatcccaccttcccgcaccctgggaccggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgtattttca

SEQ ID NO: 31221 - DNA, 570 bp, Homo sapiens
ttccagcgtcctcctcgcacactcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtaaggctggggcgcggggacttggtaggactttgccggagggcaggagtctgcgcggtgcgtgcggagctccctcccgggacgagactgggaagagcgaggcacgtggaggcggcgcgactgaggctgctggaggcgaagcggctccaggggcgggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggca

SEQ ID NO: 31222 - DNA, 578 bp, Homo sapiens
attccagcgtcctcctcgcacactcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtaaggctggggcgcggggacttggtaggactttgccggagggcaggagtctgcgcggtgcgtgcggagctccctcccgggacgagactgggaagagcgaggcacgtggaggcggcgcgactgaggctgctggaggcgaagcggctccaggggcgggtaaggggggtggacactcgggactttgggggaaagggaggccggtgtggaaaggaccggagaggcagaaccgagagcatcggcaacagaagagacccagcacccatgcctcttttctgctgggcccttttcgagcctggaagggagagacctggaggtccaacgagcgctcctccaagcggagccttggagggcacggccggcaccattacctccaacgagtggagctctcccacctcccctgaggggagca

SEQ ID NO: 31223 - DNA, 801 bp, Homo sapiens
cctccctccgcgcgctccgctccgctccgctgggcgcaccggggccggtcggcgcggggtgggcttggccccgcggccccgccttcactgcgccgcccgtcggccccggccggagcccggctctgcgcgctgacgccctgtcgtccccgcagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatga

SEQ ID NO: 31224 - DNA, 4992 bp, Homo sapiens
aaaaactgaagcaggaaaagcagctcgatgtgtctgtctatcagttgagactgtctgaaagctctgcgatccgaatgtgtgttatatttcactgaaaagaggagagagcgagagtgcatctccctctctcccaggagtttgagggggggggggacagtccacgctcatctcgcccacccagtgaatgtctgctcttcaccccctttgcacacactctccgggttgttgttgccttttttttttcttggaggggggggtgctttttgtgtatttttcaaatttttttctgttggaagatcaagaccggccaaaaatccatgatcaaaatgtgtttgcattagatttcgcattggaagaagcggcgatcctggcggccaagccccccgggtggaagcgcggggcaccaagtggcgctccggcggggtgacactgtttgatctgtgactgtttggaaggtggagcagcgcctgacatctccccccggcgcatcttatgttcctgaggaagaattgaaggcagcagaaatagatgaagagcacgtggaggatgacgggctgtctttggacattcaggaaagtgagtacatgtgcaatgaagagacggagatcaaagaggcgcagagctaccagaactccccagtcagctctgcgactaaccaggacgccggctacgggtcgcccttcagtgagagcagcgaccagctagcccatttcaaaggctcttcctctcgagaagagaaggaggatccgcagtgtcccgacagcgtctcgtacccccaggacagcctggcacagatcaaagctgtgtatgcaaacttgttctccgagtcctgctggtccagcttagctctggatttaaagaagtcgggttccaccaccagcaccaacgatgccagccagaaggagagctccgcccccacccccacaccccccacctgccccgtcagcaccactggccccaccacgagcacgcccagcaccagctgcagctccagcaccagccacagcagtaccaccagtaccagcagcagctccgggtacgactggcaccaggctgcactggccaagacgctgcagcagacgtcctcgtatgggctgcttcctgagcccagcctgttcagcaccgtgcagctctaccgccagaacaacaagctctacggctccgtcttcacgggcgccagcaagttccggtgcaaagactgcagtgccgcgtacgacacgctggtggaactgacggtgcacatgaacgagacaggccactaccgtgacgacaacagggacaaggactccgagaagaccaagaggtggtccaagcccaggaagcgctccctgatggagatggaggggaaggaggatgcccagaaggtgctgaagtgcatgtactgtggacactcctttgagtccttgcaggacctcagcgtccacatgatcaaaaccaagcattaccagaaagtgcctctgaaggagccagtgccagccatcaccaaactggtcccctccaccaaaaagcgggcgcttcaggacctggcgcccccctgctcccctgagccagcaggaatggccgcagaggtggccctgagtgagtcagccaaggatcagaaagcagcgaacccgtacgtcacgcccaataaccgctatggctaccagaatggcgccagctacacctggcagtttgaggcccgcaaggcgcagatcctcaagtgcatggagtgtggcagctcccacgacacgctgcagcagctcaccgcccacatgatggtcaccgggcacttcctgaaagtgaccacctcggcttctaagaagggcaagcagttggtgctggaccctgtggtggaagagaagatccagtccatcccactaccgcccaccacccacacgcggctgccggcctccagcatcaaaaagcagcccgactctcccgcggggtccacgacttctgaagaaaagaaagagccagagaaggagaagccgcctgtggctggcgacgcggagaagatcaaggaggagagtgaggacagcttggagaaatttgagcccagcaccctgtacccgtacctgcgtgaggaggacctggacgacagccccaagggagggctggacattctcaagtccctggagaataccgtctccacggccattagcaaagctcagaatggtgcgccctcatggggtggctaccccagcatccatgcagcctaccagctcccgggcaccgtgaagccactgccggcggccgtgcagagcgtgcaggtgcagccgtcctatgctggcggcgtgaagtcgctgtcttccgccgagcacaacgccctcctgcactccccagggagcctcacgcccccaccgcacaagagcaacgtgtctgccatggaggagctggtggagaaggtcacgggcaaggtcaacatcaagaaggaggagagaccccctgagaaggagaagagctccctggccaaggctgcgtcccccatagcaaaagagaataaagatttcccgaaaacggaggaagtcagcggcaaaccacagaagaagggccctgaggccgagactgggaaggccaaaaaggagggaccgctggacgttcacaccccaaatggcacagagcctctcaaagcaaaggtcaccaacggctgtaacaacctggggatcatcatggaccactcaccggagccttccttcatcaacccgctgagcgctttgcagtccatcatgaacacccacctgggcaaggtgtccaagcccgtgagtccctcgctggacccgctggcgatgctgtacaagatcagcaacagcatgctggacaagccggtgtaccccgccacccctgtgaagcaggccgatgccatcgaccgctactattatgaaaacagcgaccagcccattgacttaaccaagtccaagaacaagccgctggtgtccagcgtggctgattcggtggcatcacctctgcgggagagcgcactcatggacatctccgacatggtgaaaaacctcacaggccgcctgacgcccaagtcctccacgccctccacagtttcagagaagtccgatgctgatggcagcagctttgaggaggcgttggacgagctgtcaccggtccacaagaggaagggccggcagtccaactggaacccgcagcaccttctcatcctgcaggcccagttcgcctcgagcttgcgggagaccacagagggcaagtacatcatgtcggacttgggcccgcaggagagggtgcacatctcgaagtttactgggctctccatgaccaccatcagccactggctggccaatgtgaagtaccagttgaggaggacagggggaacgaaattcctaaagaacctggacacagggcatcctgttttcttttgcaacgattgtgcctctcagttcagaactgcttctacatacataagtcatttggagacacacttgggcttcagcctgaaggatctctccaagctgccactcaatcagattcaagaacagcagaatgtttcgaaagtcctcaccaacaaaactctgggcccactgggggccaccgaggaagacttgggctccacattccaatgtaagctctgcaaccggacttttgcgagcaagcacgcagtcaaactgcaccttagtaagacccacggcaagtctcccgaggaccacctgatctatgtgactgagttggagaaacagtagcgtccaggtatgcaagagaccgcggaacattgcactaaacgtcgtcgagctgcactaggcctggcctgagcctctgaaatcagtctttcctttgttgctggcccgcctctctggaccttggttttcttacacatattttgtatatttatatgctctctgtccgatctgtgcatgttatttttctttttccgtgagtcaaagtctgacctttattttcaacatctgttcttggtgttaagctatcttttgtaggaaatagtggggcacactactcagagacattatttagcagtaaagaaagacacaaataacaatgataaaaagacatcctaaaatggtgaagttgccatgacaataaaggtcatagaacctggtagtgtcaaatttaaccctttgaggactgtaattgcatttctgtgcctttcacttgaaaaaaaaaaaagaagaaaaaaaggcttaaaggcatttcattcagatcaaaagctgtgtcagacacaaaacttatttaataattaaaaaatgagcttttatatgcagaactggtttgtgaggaaacatgcatgcagctgtgggaagatagaaagctgtctaggactcacggggttcggaagccacacctctacatgtctaaaacaaaaaacaacaacaacagataccccactcgccactatgcccaaaccctctggatgctgaaaaatgccactttcggcaaaaaaaaaagtatgcaagctattatttaaaaatgtgtaaaaatgctatttcttttttcctgtaaaatattgcagtttatagttatttacaaatgtaagctttggtacaagctgacctttctatagcgtgctgcattggtaaatgaaaaaaaatggggcaaacgttggagtcctttccttgtaaattgccagcatcagcttaaaaactcctgtatgttacatatcgtaccattttaatctcttcaactttctttgtaccttctggctgtatgctttctcttttaactttttatattgtcattttatattaaatttctgtgtatataatgtaaaaccacaatttttgaataaaatttagttcctgcagcttgatttaaatagaggacttttactggcacctgcatctctccagatgcatgtactcagagggactgtcagacaaaaataaatacataaaaacaaagcaagcaatgcactattaattatacattttgatgttctatcattaatattgtacagtacattttggttcacacaattaaatccactgttttctcagatgtaaaataaacccacatgcagttcttgatttacacgga

SEQ ID NO: 31225 - DNA, 551 bp, Homo sapiens
gaccaggccggctttctccagtgcggttgggccggaaccccgggatggtaaaaaagaaaaatgcatggaggagttgaactccacattggtatttttagaagttggatgcgggaaatagccagtgccacctgaagctgtggaaacaaacaggagcttggactttgcaggcatacctctttttaaagtgaagacattttcaggaacccctggatttttaaggcttatgttcctgaggaagaattgaaggcagcagaaatagatgaagagcacgtggaggatgacgggctgtctttggacattcaggaaagtgagtacatgtgcaatgaagagacggagatcaaagaggcgcagagctaccagaactccccagtcagctctgcgactaaccaggacgccggctacgggtcgcccttcagtgagagcagcgaccagctagcccatttcaaaggctcttcctctcgagaagagaaggaggatccgcagtgtcccgacagcgtctcgtacccccaggacagcctggcacagatcaaagctgtgtatgcaaacttgtt

SEQ ID NO: 31226 - DNA, 512 bp, Homo sapiens
agcccgcgttagccatctacatactgaatcggatgtgcacttccaaatttgagatgtaggcatttctgcctcaacttgctagctgcgattttaaaagcttatgttcctgaggaagaattgaaggcagcagaaatagatgaagagcacgtggaggatgacgggctgtctttggacattcaggaaagtgagtacatgtgcaatgaagagacggagatcaaagaggcgcagagctaccagaactccccagtcagctctgcgactaaccaggacgccggctacgggtcgcccttcagtgagagcagcgaccagctagcccatttcaaaggctcttcctctcgagaagagaaggaggatccgcagtgtcccgacagcgtctcgtacccccaggacagcctggcacagatcaaagctgtgtatgcaaacttgttctccgagtcctgctggtccagcttagctctggatttaaagaagtcgggttccaccaccagcaccaacgatgccagccagaagga

SEQ ID NO: 31227 - DNA, 3468 bp, Homo sapiens
atttatttttctagaacacacccgacatgtaggctctattgcaatacatctgaaaacacaaaatctgtttgctccaaaattggtgatagcctctgacttaagatgatggtggccaggcgaggtggttcaagcctgtgattccagcactttgggaggccgaggcaggcagatcagatcatgaggtcaggagttcaagaccagcctggccaacatggtgaaacctcaggaggctgaggcaggagaattccttgaactgggacccaggaggcagaggttgcagtgagctgagatcacgccactgcactccagctggggatacagagcaagactccatctcaaaaaaagaaaaaaaagaaagaaaagatgatggctgctgcgttgctccattatacaggctacgcccaggaggaacagctgaaagaagaggaggaaataaaagaagaggaggaggaggaggacagcggttcagtagctcaactgcagggtggcaatgacacagggacggacgaggagctagaaacgggcccagagcaaaaaggctgcttcagctaccagaactctccaggaagtcatttgtccaatcaggatgccgagaacgagtctctgctgagtgacgccagtgatcaggtgtcggacatcaagagtgtctgcggcagagatgcctcagacaagaaagcacacactcacgtcaggcttccaaacgaagcacacaattgcatggataaaatgaccgctgtctacgccaacatcctgtcggattcctactggtcaggcctgggccttggcttcaagctgtccaatagtgagaggaggaactgtgacacccgaaacggcagcaacaagagtgattttgattggcaccaagacgctctgtccaaaagcctgcagcagaacttgccttctcggtccgtctcgaaacccagcctgttcagctcggtgcagttgtaccgacagagcagcaagatgtgcgggactgtgttcacaggggccagcagattccgatgccgacagtgcagcgcggcctatgacaccctagtcgagctgactgtgcacatgaatgaaacgggccactatcaagatgacaaccgcaaaaaggacaagctcagacccacgagctattcaaagcccaggaaaagggctttccaggatatggacaaagaggatgctcaaaaggttctgaaatgtatgttttgtggcgactcctttgattccctccaagatttgagcgtccacatgattaaaacaaaacattaccaaaaagtgcctttgaaggagccagtcccaaccatttcctcgaaaatggtcaccccggctaagaaacgcgtttttgatgtcaatcggccgtgttcccccgattcaaccacaggatcttttgcagattctttttcttctcagaagaacgccaacttgcagttgtcctccaacaaccgctatggctaccaaaatggagccagctacacctggcagtttgaggcctgcaagtcccagatcttaaagtgcatggagtgtgggagctcccatgacaccttgcagcagctcaccacccacatgatggtcacaggtcactttctcaaggtcaccagctctgcctccaagaaagggaagcagctggtattagacccgttagcagtggagaaaatgcagtcgttgtctgaggccccaaacagtgattctctggctcccaagccatccagtaactcagcatcagattgtacagcctctacaactgagttaaagaaagagagtaaaaaagaaaggccagaggaaaccagcaaggatgagaaagtcgtgaaaagcgaggactatgaagatcctctacaaaaacctttagaccctacaatcaaatatcaatacctaagggaggaagacttggaagatggctcaaagggtggaggggacattttgaaatctttggaaaatactgtcaccacagccatcaacaaagcccaaaacggggcccccagctggagtgcctaccccagcatccacgcagcctaccagctgtctgagggcaccaagccgcctttgcctatgggatcccaggtactgcagatccggcctaatctcaccaacaagctgaggcccattgcaccaaagtggaaagtgatgccactggtttctatgcccacacacctggccccttacactcaagtcaagaaagagtcagaagacaaagatgaagcggtgaaggagtgtgggaaagaaagtccccacgaagaggcctcatctttcagccacagtgagggcgattctttccgcaaaagtgaaacacctccagaagccaaaaagaccgagctgggtcccctgaaggaggaggagaagctgatgaaagagggcagcgagaaggagaaaccccagcccctggagcccacatctgctctgagcaatgggtgcgccctcgccaaccacgccccggccctgccatgcatcaacccactcagcgccctgcagtccgtcctgaacaatcacttgggcaaagccacggagcccttgcgctcaccttcctgctccagcccaagttcaagcacaatttccatgttccacaagtcgaatctcaatgtcatggacaagccggtcttgagtcctgcctccacaaggtcagccagcgtgtccaggcgctacctgtttgagaacagcgatcagcccattgacctgaccaagtccaaaagcaagaaagccgagtcctcgcaagcacaatcttgtatgtccccacctcagaagcacgctctgtctgacatcgccgacatggtcaaagtcctccccaaagccaccaccccaaagccagcctcctcctccagggtcccccccatgaagctggaaatggatgtcaggcgctttgaggatgtctccagtgaagtctcaactttgcataaaagaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaatagctctgcagg

SEQ ID NO: 31228 - DNA, 7935 bp, Homo sapiens
gtgtgtgtgtgcgagggtgtgtgtgtgtgtttgtgtgtgtgtgcatatgtggggggtgtgagtgtgtgtgtgcgaggaagcgggggtgcgtgcgcgtgtgagtgcgtgtgtgagtgtctgtgtgtgtgtctgtgtgtgtgtgtgagtgagtgaattccagattttctgtctttccaaaacccgctcctgtcctctcgcatatcactcacagacggggatctgacagcagccacaaacctacagtgagtgatcgctctccccccggcacgaatccgccatagagatcggcgaggaggaggaggaggaggaggaagaaaagaaggaggaggtggaggaggaggtggaggaggaggaggaggagggaaagaggagaaggaagaagaagaaaaagaagaaacccactaccttcccaggattgccttttttttttccttatctttacgcgcgagtgtgcctgtggcgcgtgtgcgcccctcgtcccttccatccgaacccgggcttggatgtttaataaagaaatcaagtgtctcaacagtcaccaaaaaaaaaaaaaaccgcaaaaacaaaaccaaaaaaattccaaaagcaaaaacaaaaaagagagaggaaaaaaaattcaaaataaacaaacaaacaaacaaggcagaaccaacctctacttcaaagcagccggcacaagccacccgtgtctgccacccagagaggggggtctctggcccgtggtggaggagttgcaggggggatcgtcagggggacagaggccgagtgacgtcctaggagccaccgggcaagaggcggaggagacccagagaggccagagagacagcgggccccagcgcgcggctcggggctggggcgccagaagtgggactggagcgaagtagaggatgccgaggagaaaacagcaggcacccaagcgggcggcaggctacgcccaggaggaacagctgaaagaagaggaggaaataaaagaagaggaggaggaggaggacagcggttcagtagctcaactgcagggtggcaatgacacagggacggacgaggagctagaaacgggcccagagcaaaaaggctgcttcagctaccagaactctccaggaagtcatttgtccaatcaggatgccgagaacgagtctctgctgagtgacgccagtgatcaggtgtcggacatcaagagtgtctgcggcagagatgcctcagacaagaaagcacacactcacgtcaggcttccaaacgaagcacacaattgcatggataaaatgaccgctgtctacgccaacatcctgtcggattcctactggtcaggcctgggccttggcttcaagctgtccaatagtgagaggaggaactgtgacacccgaaacggcagcaacaagagtgattttgattggcaccaagacgctctgtccaaaagcctgcagcagaacttgccttctcggtccgtctcgaaacccagcctgttcagctcggtgcagttgtaccgacagagcagcaagatgtgcgggactgtgttcacaggggccagcagattccgatgccgacagtgcagcgcggcctatgacaccctagtcgagctgactgtgcacatgaatgaaacgggccactatcaagatgacaaccgcaaaaaggacaagctcagacccacgagctattcaaagcccaggaaaagggctttccaggatatggacaaagaggatgctcaaaaggttctgaaatgtatgttttgtggcgactcctttgattccctccaagatttgagcgtccacatgattaaaacaaaacattaccaaaaagtgcctttgaaggagccagtcccaaccatttcctcgaaaatggtcaccccggctaagaaacgcgtttttgatgtcaatcggccgtgttcccccgattcaaccacaggatcttttgcagattctttttcttctcagaagaacgccaacttgcagttgtcctccaacaaccgctatggctaccaaaatggagccagctacacctggcagtttgaggcctgcaagtcccagatcttaaagtgcatggagtgtgggagctcccatgacaccttgcagcagctcaccacccacatgatggtcacaggtcactttctcaaggtcaccagctctgcctccaagaaagggaagcagctggtattagacccgttagcagtggagaaaatgcagtcgttgtctgaggccccaaacagtgattctctggctcccaagccatccagtaactcagcatcagattgtacagcctctacaactgagttaaagaaagagagtaaaaaagaaaggccagaggaaaccagcaaggatgagaaagtcgtgaaaagcgaggactatgaagatcctctacaaaaacctttagaccctacaatcaaatatcaatacctaagggaggaagacttggaagatggctcaaagggtggaggggacattttgaaatctttggaaaatactgtcaccacagccatcaacaaagcccaaaacggggcccccagctggagtgcctaccccagcatccacgcagcctaccagctgtctgagggcaccaagccgcctttgcctatgggatcccaggtactgcagatccggcctaatctcaccaacaagctgaggcccattgcaccaaagtggaaagtgatgccactggtttctatgcccacacacctggccccttacactcaagtcaagaaagagtcagaagacaaagatgaagcggtgaaggagtgtgggaaagaaagtccccacgaagaggcctcatctttcagccacagtgagggcgattctttccgcaaaagtgaaacacctccagaagccaaaaagaccgagctgggtcccctgaaggaggaggagaagctgatgaaagagggcagcgagaaggagaaaccccagcccctggagcccacatctgctctgagcaatgggtgcgccctcgccaaccacgccccggccctgccatgcatcaacccactcagcgccctgcagtccgtcctgaacaatcacttgggcaaagccacggagcccttgcgctcaccttcctgctccagcccaagttcaagcacaatttccatgttccacaagtcgaatctcaatgtcatggacaagccggtcttgagtcctgcctccacaaggtcagccagcgtgtccaggcgctacctgtttgagaacagcgatcagcccattgacctgaccaagtccaaaagcaagaaagccgagtcctcgcaagcacaatcttgtatgtccccacctcagaagcacgctctgtctgacatcgccgacatggtcaaagtcctccccaaagccaccaccccaaagccagcctcctcctccagggtcccccccatgaagctggaaatggatgtcaggcgctttgaggatgtctccagtgaagtctcaactttgcataaaagaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaatagctctgcaggacgaatgccttagtttccactttccagcctggatcccctcacactgaacccttcttcgttgcaccatcctgcttctgacattgaactcattgaactcctcctgacaccctggctctgagaagactgccaaaaaaaaaaaaaaaaaaaaatcaccccagccatttctcttcatcctcactaacaatttggtaatgaagtattgatttccacttctctgcttatgggcggtattagattttcattgataaattgcaatggggctgtctcgtctccacagtacccttttcactgtcacaagaaaacaaagtgccaccgaagaaaagtaatgactgagagcattgatgtacttattttgtcagtttgtaacaggaaagtgggggggagtctaagtcttcatagtctaatgtccaagtgggttgcactagatgtagacacttggaggcttacttttcatggtaatgtccatttcctatttataacccctctgggaacgtttgtctaaaggaaatgtttctgttcagtgtaacaattacagttgcacctggattgcccagtcctgcccctgcactaggggaccattaatcactgcaaagtagaagaattattaagttaaaccagagtttgagccaagaaaacccctgaacaatgttcatcttctgtgaaacttgctcaaatagttaagcttaaccatgttgctgccaaagacttttcctatgcagtggtggggcaccttgatcatcatcattatcttgattggctgaaaaaaaaatagttttaagcacacaccactgtctatgagaactgcaaattgggagaataggtgaaatgcagaatctgagagaacgcgagaagatgagatcattacagggtggaaagttctgcagcagccttttctggtaatccctttctgcagaacctgatgtttatgggctctaaaacgcagcttagctttagaagcaacagaaagcatgaaatagggtgtccattttaaatgtgttcctgcaacttttttcattaaaactttgagggcccaattttaatttgtggaatattcccgttaataatgagatctaattaagacatccattaaaagcccgttaaagttaatttaacgtaaaaattccaatagaactgtattagattttctccattaaattaacgttatggatttttaacggatgtcttaattatacgttattattaacgggaatactgtattacacagattaaaatcaggtcctaagtcaacttggaagagctaagagcatgttttaatattaaaagtcttgcatacctagtgcacagtttggagacgcaaggatagatctgtttactctagttgaacattttctatacaattgaaagcaacctataatagataaatccatcattgcatttaaacaatgaatttccttattctcaaaggacaaatacgtctggattatgtggtaaattgctactcagctatggtgaaatatttatactattctaggcacaacactaggaactaggtgattctgaaacaaaaggaatattttctgttgttgctttaattaccaaggttatttttttttaatctcaacactgacaaaatgaaaccaaatatctcttcctcaccatttctcaaggaggctgcctgttggaattgttttggaaattttgacatgatccctaaattcaacattgggattaaaaaaaaaaaaaaacttcttatttacctcctagggaaagtgttgcccttatgccacatataatagcaaattgctttttttatggcatgcataacctagatgggaaaaaatatggcgcttcggggaaggagggaaaaagtaaatgaagttccaggaatgtcattctgaagtaatgaggcatggacagaaaatatacccctcacatcatcggattgagatggcagtcgaaatagcttcattgaagtgtcagcactcatccatcaatcaatcacccacaaggaaaaatagcaacagtacaacggggtggcttttatgggatttactcatgggcatagggaatagcggctcaaatgtagttctgacatgaaaagcaaggtgctgatattattttttatgatgggaggatcataaagtgaattgagaacagtgaggtctgtctttgcttaacctattcaaccagaaatgaatggagctcgactggaaaggaacagtcttcagatgggttaagattgaagggtggactggactctactgagcaccgtccttcaacaaggaaattctattaaaggaaaatcaatgcattagtattggggttctcgtagctgttaaaaattgtctgctccaatccagggttattaggccaaagttacataattcagatctcactgcaaccatccaaaagtggattctcgagcccttgctccaatggggggaggagatcaatacaattcccaattccatggaaattgtttcccttctaaggaagaaaaaataaatcatctgcttcaacatataatcgatatggttttgttagcgtaatttctatggtgggtggggtgggaggtgagagaaaaaaatattgataaatttggtaagacaggtgaattgccgcctggcaaccgtgcatgtcactgccgagggatggctgctaaggttcaccttagaaaacaagatctgggctggcactggggcatacatcaccactcagcatattcctagaggccaggcctgtcttcactcagccagccctctgaggcttctagaaacttctttctggaggaaaaaaactaaataacataaactcaggagaatgtctttacccaccttcataccactgctttctttttgctgaataaaacacagttctgataagtaagaactttagaattggaaaggaggctgacatgcaaatataatgcaaattaccctcaagtatcgccattcttccaccacctcttggtaccagtgagagcgagagattgccttttcttccccatccctccttccagctaagaccaccaaccagctgcaaattgagatgtccatttaaaaatttatatgtcaatatttaaatgttacatatttggccctattttgtagttcagcaaatcctccaaatacacagcatgttacaaggcactggtggcacagggcacaacaggaaatgatatttatttagcaaattcatttaacaaatattattgggcacctgttatgtgagacactgtcctaggcactgtgggataacaacagcaaacacttcacacaacagcctggccttcctgtgttttacaacagctcctaaagatagctgatatcaagacatttgagggacacagttcatgtagaatcaaaatattagtatttcagaataaggattttttttctgaaaagcatacagagaggaaacagcttaaaaataggtcaagacctaaaaacagaatataatcacggaataaactggataacccagacagtccccacagaatttctttcaggtcacagatttcttaaaactcacccccaaaatgtgcctgcttggttgtttgaatcttgcataattaatgtcacaggcgcaagccgctgaacttagttgagatgcagaaaacaaacaaatgcaatgacatatctgagaagcatttatgtaactccggttaagtggtgaggaggggtgtgtgaagacagtgtgcatgcatgagtgtgtattcatatatatgtgtatacatatgaatttcactgttattttccagggtctatggacaatgtggcagtaagagtctatgatgttctgaaacttttcacagtaaatccaaagattacagaccttacaaggtgcttgcattctgttgcttttccatctgtcacttctcaggttatttgactgtgttcaaaccttcttttctttttcattgagtttcattttttaagcttgttaaatgcttttgtttaaaaaaaaaaaaaaa

SEQ ID NO: 31229 - DNA, 5176 bp, Homo sapiens
cttcccattccgccggcagcgcggtcctcctcctcctcctccacctcctcctcctctgcctcctcctcccccccgtgctcctccctccccgagcctccctcgcccgccctccttcttccctccgcacgttcggggttcgcggcggagcgcggcgcgggggggacgcggagagcctgggcgcagcagcatcctgcgggcggccgctctccgggggggaggctgagagcaggcccgcctcgcccccccgcgggcccgccgccccctccctccctgtcctcagcccggcagcggcggcggcggcggcagtggcagtcgccggagaagcatcatgccgaggaggaagcagcaggcgccccggcgcgcagcagcctatgtttccgaagagttaaaggctgctgccctggtggacgaaggtttagacccagaggagcatacggcagatggagagccctcggccaagtacatgtgcccggagaaggagctcgccagggcctgccccagctaccagaactccccggccgccgagttttcctgccatgaaatggacagcgagtcacacatcagtgagaccagtgaccgaatggctgactttgaaagcggctccatcaagaacgaagaggagaccaaggaggtcacggtcccactggaagacacgactgtgtcggatagcctggagcagatgaaggccgtgtacaacaacttcctctccaactcctactggtccaacctcaacctcaacctgcaccagccctcctcggagaagaacaacggcagcagcagcagcagcagtagcagcagcagcagctgtggcagcgggagcttcgactggcaccagagcgccatggctaagacgctgcagcaggtgtcacagagccgcatgctcccggagcccagcctcttcagcaccgtgcagctgtaccggcagagcagcaagctctatggctccatcttcacgggggccagcaagttccgctgtaaggactgcagcgctgcctacgacaccctggtggagttgacggtgcacatgaacgagacggggcattaccgcgacgacaaccatgagaccgataacaacaaccccaagcgctggtccaagcctcgcaaacgctccttgctggaaatggaagggaaggaagacgcccagaaggtgctgaagtgcatgtactgtggccactcctttgagtccctgcaggatttgagtgtccatatgatcaaaacaaaacactaccaaaaagtgcctctgaaggaacccgtcactcctgtcgccgccaaaatcatccctgccactcggaagaaagcttccctggagctggagctccccagctccccagattccacaggtggaacccccaaagccaccatctcagacaccaacgatgcacttcagaagaactccaacccttacatcacgccaaataatcggtacggccaccagaatggggccagctatgcatggcactttgaggcccggaagtcgcagatcctgaagtgcatggagtgtgggagctcgcatgacaccctgcaggagctcactgcccacatgatggtcactggccacttcatcaaggtcaccaactctgctatgaaaaaggggaagcccattgtggagacgcctgtcacacctaccatcacaaccctgctggatgagaaggtccagtccgtgcccctggcagccaccaccttcacgtccccctccaatacacctgccagcatctccccaaaactgaatgtggaggtcaagaaggaagtcgacaaggagaaagcggtcactgacgagaaacctaagcaaaaagacaagcctggcgaagaagaggagaagtgtgacatctcttccaaataccattacttgactgaaaatgacttagaagagagtcccaagggggggcttgatatcctcaaatccttggaaaacacagtgacatccgcaatcaacaaggcccagaacggcactcctagctgggggggctatcccagcatccatgccgcctaccaacttcccaacatgatgaagttgtccctgggctcgtcggggaagagcacgcccctgaaacccatgtttggcaacagtgagattgtctccccgacgaaaaaccagaccctggtctctccacccagcagccagacgtcccccatgcccaagacaaactttcatgccatggaggagctggtgaaaaaggtcactgagaaagttgccaaagtggaggagaagatgaaggagccggatgggaagctttccccgcccaagcgggccactccctccccatgtagcagcgaagtcggggaacccatcaagatggaggcatccagcgatgggggcttccgcagccaggagaacagccccagccccccgcgggatgggtgcaaggatgggagccccctcgctgagccggtggagaatggcaaggagctggtgaagcccctagccagcagtttgagtggcagcacggccatcatcaccgaccacccgcctgaacagccttttgttaaccctttgagcgccctgcagtcagtcatgaacattcacctgggcaaggccgccaagccctccctgcctgccctggaccccatgagcatgcttttcaagatgagcaacagcctggcggagaaggctgctgtggccaccccgccgcccctgcagtccaagaaggcagaccacctcgaccgctatttctaccacgtcaacaacgaccagcccatagacttgacaaaagggaagagtgacaaaggctgctccttgggttcagtgcttctgtcacccacgtccacagccccggcaacctcctcatccacggtgacaacggcaaagacatctgccgtcgtatcattcatgtcaaactcgccgctacgcgagaatgccttgtcagatatatccgatatgctgaagaacttgacagagagccacacgtcaaaatcctccactccttccagcatctccgagaagtctgacattgacggggccactctggaggaggctgaggagtcgacgcccgcccagaagaggaagggccgccagtcaaactggaacccccagcacctcctgatcctccaggcccagtttgccgccagcctccggcagacctcagaagggaagtacatcatgtcagacctgagcccccaggagcggatgcatatctccaggttcaccgggctgtccatgaccaccatcagccactggctggccaacgtgaaataccagcttcgaaggacaggtggaacaaagttcctcaaaaacttggacactggccaccccgtcttcttttgtaacgattgtgcgtcccaaatcaggactccttccacgtacatcagtcacctagagtcacacttaggcttccggctacgggacttatccaaactgtccaccgaacagattaacagtcagatagcacaaaccaagtcaccgtcagaaaaaatggtgacgtcctcccccgaggaagacctggggacttcctatcagtgcaaactttgcaatcggacctttgccagcaagcacgctgttaaacttcaccttagcaaaacacacgggaaatctccggaagaccaccttctgtatgtctctgagttagagaagcagtagcatttgcttttgatagaaaggactgcagtttgctttgagggaaactgtggaaggcaccttcaggccccctctgacttgttgttcttggcacatgttcttattttaactgcagagaatcactctgggctggactgttttgtataactgtacagtgtttaatagaggtgcataatcagctgttgttactggtaaaatatgaaggttaaaatgcagtggtaagtgtttggaactttgtgtaaacgggatttagttgtgagcatcctcccgatgcttcaagctgcatgcattaacagacagtttaattaagcatttataacggaatcaggcacaccttttccacgagactcgagtgtgctggcatttctcaccctttcatctttagccctctgagtactttgaagcacttttgcattaatttggttaaaaaataaaataaaataataataatgtatgaagctctgttttttaaactccttaccagcttagttataatgaataatatgaacctccatttatgcaggtctgcaggggtataacacgccttgaaatttaaaagaatattattttcacattgaaacatagatgtatatattgtatagatttcagactctcttatgaaaaaaaatgtgattgtggttaaatgacctttttcttgcatttatagcaacagtgttttatgcacctgctatgctctgggcataagctgtgcctatgtatagtgtatatttctttttttcttttttttaaggtctatgggttttgttttttacatgcaaacattgtaaattatacagaagataccacagatagcatttataaagtatacagaaacattatctgaaagcaaagtatgatagtttgttttgctatacagtacatctatattgatagaggttcatgtttaaattatacatatttattagcatcatattgtcatttgttttgagcagtctgaataaacgagaccgggaaagacatccctggcaggcatcagaactattttgcacatgatttttaaaggtatttattagaaatcaaagaacactcaaaataaactcagtgctcaaagggttaagtctatttgaaaaggttaaaaaaaagaacaaaaaaaaaaaaagaacttgtactgtatttcctaaacattgataaagcctttaaaatgtttgtactgtaatactttgcttaaaagtcatgaggcattctgtgatccaacctctttcacttatttataagccctcttggttgctattccatattgtaggatgcctttctatttcaattggtaactttctgttttgttcttcctaattattctcccaagatcccacactgcagctttatctttaggcttatgaaaggtaacccgtggttaccggctctccaagtgattctgttcttctccatttttggcagttaatttgcagaagtaactgacagctgacaccatatgagaacctttgtataaaatattggcatgtaaacagcacagacaccgtaacacactctgtgccctgtttggttgttgacaatgaagcaccattatgtgactcttcatataacccttttttctacggcagcattaaaattgtctttttgctataa

SEQ ID NO: 31230 - DNA, 3687 bp, Homo sapiens
gggcggggcggggcgctttgctctggactctggggcgctaggctccggactccgcggcgcagactgcacctcgcagtctccccaggtccgcccagcagccgcgcttcagccagaatactgggatcttcagtggcaggaggagtaatcagaagacggagatgaattttaacactattttggaggagattcttattaaaaggtcacagcagaaaaagaagacatcgcccttaaactacaaagagagactttttgtacttacaaagtccatgctaacctactatgagggtcgagcagagaagaaatacagaaaggggtttattgatgtttcaaaaatcaagtgtgtggaaatagtgaagaatgatgatggtgtcattccctgtcaaaataagtatccatttcaggttgttcatgatgctaacacactttacatttttgcacctagtccacaaagcagggacctgtgggtgaagaagttaaaagaagaaataaagaacaacaataatattatgattaaatatcatcctaaattctggacagatggaagttatcagtgttgtagacaaactgaaaaattagcacccggatgtgaaaaatacaatctttttgagagcagtataagaaaagcactacctccagcaccagaaacaaagaagcgaaggcctcccccaccaattccactagaagaagaagataatagtgaagaaatcgttgtagccatgtatgatttccaagcagcagaaggacatgatctcagattagagagaggccaagagtatctcattttagaaaagaatgatgttcattggtggagagcaagagataaatatgggaatgaaggatatatcccaagtaattacgtaacgggaaagaaatcaaacaacttagatcaatatgaatggtattgcagaaatatgaatagaagcaaggcagagcaactcctccgcagtgaagataaagaaggtggttttatggtaagggattccagtcaaccaggcttgtacacagtctccctttataccaagtttggaggagaaggttcatcgggttttaggcattatcatataaaggaaacaacaacatctccaaagaagtattacctagctgaaaaacatgcttttggctccattcctgagattattgaatatcataagcacaatgcagcaggacttgtcaccaggcttcggtacccagttagtgtgaaagggaagaatgcacccaccactgcaggattcagctatgagaaatgggagattaacccttcagaactgacctttatgagggaattgggaagtggactgtttggagtggtgaggcttggcaaatggcgagcccagtacaaagtcgcaatcaaagctattcgggaaggtgcaatgtgcgaggaggactttatagaagaagctaaagtgatgatgaaactgacacacccgaagttagtgcagctttatggtgtgtgcacccagcagaaaccaatatacattgttactgagttcatggaaaggggctgccttctgaatttcctccgacagagacaaggtcatttcagtagagacgtactgctgagcatgtgtcaggatgtgtgtgaagggatggagtatctggagagaaacagcttcatccacagagatctggctgccagaaattgtctagtaagtgaggcgggagttgtaaaagtatctgattttggaatggccaggtatgttctggatgatcagtacacaagttcttctggtgctaagtttcctgtgaagtggtgtccacctgaagtgtttaattacagccgcttcagcagcaaatcagatgtctggtcatttggtgttttaatgtgggaagtattcacggaaggcagaatgccttttgaaaaatacaccaattatgaagtggtaaccatggttactcgaggccaccgactctaccagccgaagttggcgtccaactatgtgtatgaggtgatgctgagatgttggcaggagaaaccagagggaaggccttctttcgaagatctgctgcgcacaatagatgaactagttgaatgtgaagaaacttttggaagataagtgatgtgtgaccagtggctcccagattcccaagcacaaggaaggatgggcattttgtggcttttaatttattgagcacttggacatgtagatcattttacttatacagtggaaacacataaataatttgcttctagaccagcctctgtctagacttgcttctagacagaatctcccagagtgtggaaatgttgccttagaaatggtgattaaaatcactcatttctattcattcctcaggcacttgagtgacagttgtttaccaggcactgtgtgtagccccagggtttggccattcaggggtgcacacatgggaccatgttagctgatgccagttgaaggccagggtatttgggaaggggaagggtattagagtcatgaccaagcaacccttctttttccctttgacttctacagaaatctgggcctgagacattgtctacaattgggttctagatacatcaggaacccatcttggataaataaatacctatcttttgttttgaaaacatctcagttttcaagactgctcttagtattacatgaacaatatttgtatgctgtatatattgtaaatatatataatatataaagttatatatttatgagaaacacgaattgtcttttaattgaaacttttaatcctgtagtataggagttcaccttcttaggactagagactgtgccttatagctgttaattcatttccccctgaacatcaaatatgcctgaagagaagaaagtctagattcttctatgagtaacgccccctcctcactcaggtaaatgtgtctggggatgcctgtccagcttaaccacgtgcatttggcctatgtaatcctgcccatggtggccgcagctaatcagaatcagatggaaaattaaaccgggtaatctacttctaagccttaagaatattccctgggacacagacactataattggaagtgctgagctctggggcagaaggatcaggtgaccttcgcaacaaagtttgcccccacctcacataggacccggaagcagcctgagctgtggcggaggatccaggaagctacggagagaagcagccagcatggtgttccgtgcctcccggacgtttttcaggaggcctggttggacttgggttcctggatggtgggattgttgtacagcctctcaggagaccctgctgtcaagactgtgtgtgtggatttctcacccttagaagctctactaagacatcaacggaattagggccttcctttttgccttgtgagcgccaaggaaaagaaactatctcggtcacgtgagcgccagcgaaaagaaactgtatcagtcatccagagaccgtttattgcccaacacgttattcttgctgttggtggggtaactagccgaggaagacacagcgccttcccttcaggagttgcgtctcctctgcaggccacgatggtctgctctggagcattgggtgaacacacaggctggctgctctgggcagcgccttcactctgaccctggagaaccatttcatttcatcctggtcagtctagagtctgtgcaccaggcagtccatccactgaaggctgtgtttattcttttcctgtgcccctcataatggaagaaagtaaactgcttatcccgagcctta

SEQ ID NO: 31231 - DNA, 2910 bp, Homo sapiens
atagctccgggcgttcgcttgcaagatggcggcggcggggcagtggctgctgcgttttcgtgtctgagtccttcctgggttctaatgagggcgcggttctgctgtgcccggcccgcgaggtctaaggcatgggcttccagcctccggccgctcttcttttgaggcttttccttctgcagggcatcctgaggcttctgtggggggacctggctttcatccctccttttatccgaatgtccggccctgcggtcagcgcgtccctggtcggagacaccgagggtgtgaccgtgtccctggcagtgctgcaggacgaggcgggaatattgccaattccgacgtgtggagtgctgaacaatgagacggaagactggagcgtgactgtgatccccggtgcgaaggtgttggaagtgacagtgaggtggaagagaggtctggactggtgttcctccaatgagacagattccttctcagagtccccctgtatcctccagacccttctggtttcagcatctcataattcatcctgttcagcacatctactcattcaagtggaaatttatgccaactcttctctgacccataatgcctcagagaacgtgactgtcattcctaaccaggtgtatcagccccttggcccttgtccttgtaatttaacagctggagcctgtgatgttcgctgctgctgtgaccaggaatgctcatcaaatttaacaacgctgttcagacggtcctgcttcaccggcgtgtttggaggagacgtcaatcctccttttgatcagctctgctctgctgggacgacgacacgtggtgtccccgattggtttccctttctgtgtgtgcagtccccccttgccaacacacccttccttggttacttctatcatggtgctgtttcccccaaacaggactcttcctttgaagtatatgtggatactgacgcaaaagactttgcagactttggttacaaacaaggagatcccattatgactgtaaagaaggcatattttactattccgcaggtgtccctggctgggcagtgtatgcagaacgccccagtggcatttcttcacaattttgatgttaaatgcgttactaatttggaactataccaagaacgagatggtattatcaatgcgaagataaagaatgttgccttaggaggcatagttacaccaaaagtgatctatgaggaagcaactgacctagacaaattcatcaccaatacagaaactcctttaaataacggatcaacccctagaattgtgaatgtggaagaacattatattttcaaatggaataataataccatcagtgaaataaatgttaaaatttttagggcagagattaatgcccaccagaaagggataatgacacagagatttgtagtaaaatttttaagctataatagtggtaatgaagaagaattatctggaaatccaggttaccaacttggcaagcctgtccgagctctaaatatcaacaggatgaataatgtcacgactttacatctttggcaatcggctggaaggggtctgtgtacatcagcaactttcaaacccattttatttggagaaaatgtactctctggatgcctgttagaagtcgggattaatgaaaattgtactcagctcagggagaatgctgttgaaagacttgattcattaatacaagcgactcacgttgcaatgagaggcaactccgattacgctgatcttagtgatggctggctcgaaataatacgtgtagatgcccctgatccaggtgcagacccgctggctagcagtgtgaacggcatgtgcctggatattcctgctcacctgagcatccgcatcctcatctcggatgctggcgcggtggaagggattactcagcaggagatactcggtgtagagacaaggttctcctcagtgaactggcagtaccagtgtgggcttacctgtgagcacaaggccgaccttctccctatcagtgcatccgtccagtttattaaaattcctgcacagttaccccaccccctgacaagattccagatcaattatacagagtatgactgcaacagaaatgaggtgtgttggccgcagcttctatatccatggactcagtattatcaaggggagctgcattctcagtgtgttgctaagggcttactgttgctgttgttcctcacattggccttgttcctcagcaacccctggaccagaatatgcaaagcctatagttagacaaccacctggcttttatttttttgagatggagttttgctcttgttgcccaggctgaagtgatctcggctcaccacaacctcctcctcttgggttcaagcgattctcctgcctcagcctccggagaactgggattacaggcatgcaccaccacgcccggctaattttgtatttttagtagagacagggttccaccgtattggccaggctgctctcgaactcctgacctcatgatccgcccatcttggcctcccaaagtgctgagattacaggcatgagccaccgcacccggcctttttttttttttttttttttttgaggcggggtctctgtcacccaggctggagtgcagtgcacaatctcggctcactgcaatctctgcctcccaagcaatcctcccacctcagcctctggtgtagctgggaccacagatgctccaccatgcctggctgtatttttggtaaagacggggtttcgccttgttgcccagggtggtctgtaactcctgagctcagatgatctgcccacctcggcctcccaaagtgctgggatcacagacgtgagccactgcgtccggtccatctgacttctcaaagactttagaccttgacttcagtgatttgttgtagtcttgtatgcttctctataaaattttaataaatgaaatgtcttatttttgtagaaaatt

SEQ ID NO: 31232 - DNA, 2513 bp, Homo sapiens
atagctccgggcgttcgcttgcaagatggcggcggcggggcagtggctgctgcgttttcgtgtctgagtccttcctgggttctaatgagggcgcggttctgctgtgcccggcccgcgaggtctaaggcatgggcttccagcctccggccgctcttcttttgaggcttttccttctgcagggcatcctgaggcttctgtggggggacctggctttcatccctccttttatccgaatgtccggccctgcggtcagcgcgtccctggtcggagacaccgagggtgtgaccgtgtccctggcagtgctgcaggacgaggcgggaatattgccaattccgacgtgtggagtgctgaacaatgagacggaagactggagcgtgactgtgatccccggtgcggtgttggaagtgacagtgaggtggaagagaggtctggactggtgttcctccaatgagacagattccttctcagagtccccctgtatcctccagacccttctggtttcagcatctcataattcatcctgttcagcacatctactcattcaagtggaaatttatgccaactcttctctgacccataatgcctcagagaacgtgactgtcattcctaaccaggtgtatcagccccttggcccttgtccttgtaatttaacagctggagcctgtgatgttcgctgctgctgtgaccaggaatgctcatcaaatttaacaacgctgttcagacggtcctgcttcaccggcgtgtttggaggagacgtcaatcctccttttgatcagctctgctctgctgggacgacgacacgtggtgtccccgattggtttccctttctgtgtgtgcagtccccccttgccaacacacccttccttggttacttctatcatggtgctgtttcccccaaacaggactcttcctttgaagtatatgtggatactgacgcaaaagactttgcagactttggttacaaacaaggagatcccattatgactgtaaagaaggcatattttactattccgcaggtgtccctggctgggcagtgtatgcagaacgccccagtggcatttcttcacaattttgatgttaaatgcgttactaatttggaactataccaagaacgagatggtattatcaatgcgaagataaagaatgttgccttaggaggcatagttacaccaaaagtgatctatgaggaagcaactgacctagacaaattcatcaccaatacagaaactcctttaaataacggatcaacccctagaattgtgaatgtggaagaacattatattttcaaatggaataataataccatcagtgaaataaatgttaaaatttttagggcagagattaatgcccaccagaaagggataatgacacagagatttgtagtaaaatttttaagctataatagtggtaatgaagaagaattatctggaaatccaggttaccaacttggcaagcctgtccgagctctaaatatcaacaggatgaataatgtcacgactttacatctttggcaatcggctggaaggggtctgtgtacatcagcaactttcaaacccattttatttggagaaaatgtactctctggatgcctgttagaagtcgggattaatgaaaattgtactcagctcagggagaatgctgttgaaagacttgattcattaatacaagcgactcacgttgcaatgagaggcaactccgattacgctgatcttagtgatggctggctcgaaataatacgtgtagatgcccctgatccaggtgcagacccgctggctagcagtgtgaacggcatgtgcctggatattcctgctcacctgagcatccgcatcctcatctcggatgctggcgcggtggaagggattactcagcaggagatactcggtgtagagacaaggttctcctcagtgaactggcagtaccagtgtgggcttacctgtgagcacaaggccgaccttctccctatcagtgcatccgtccagtttattaaaattcctgcacagttaccccaccccctgacaagattccagatcaattatacagagtatgactgcaacagaaatgaggtgtgttggccgcagcttctatatccatggactcagtattatcaaggggagctgcattctcagtgtgttgctaagggcttactgttgctgttgttcctcacattggccttgttcctcagcaacccctggaccagaatatgcaaagcctatagttagacaaccacctggcttttatttttttgagatggagttttgctcttgttgcccaggctgaagtgatctcggctcaccacaacctcctcctcttgggttcaagcgattctcctgcctcagcctccggagaactgggattacaggcatgcaccaccacgcccggctaattttgtatttttagtagagacagggttccaccgtattggccaggctgctctcgaactcctgacctcatgatccgcccatcttggcctcccaaagtgctgagattacaggcatgagccaccgcacccggcc

SEQ ID NO: 31233 - DNA, 2739 bp, Homo sapiens
ggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtactaattcca

SEQ ID NO: 31234 - DNA, 2436 bp, Homo sapiens
acgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtact

SEQ ID NO: 31235 - DNA, 1464 bp, Homo sapiens
atgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcagtatcctttttagagctgggtggcctgttgcagcctaatgagaaaagctgcaaaggctttcaaacttatgttagactagccaaaggtgaggaattttttgttcattataatgaggtacttatatactaatatatggttaatcatttttggaatctagttgtctctctgtggttttctgaggaaaaaaatcacaaatttgtgactcgaacattatgatagtaatacaaaataaatagcattaaaggagaatgagaacataaa

SEQ ID NO: 31236 - DNA, 2734 bp, Homo sapiens
ggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtactaa

SEQ ID NO: 31237 - DNA, 2295 bp, Homo sapiens
ggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactgtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggaggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtactaattcca

SEQ ID NO: 31238 - DNA, 6468 bp, Homo sapiens
atgaattattcatcattccttagaatttgggtctctttcatcttcgcacttgtacagcaccaagctcagcccagggagctcatgtatccattttggcagaatgacaccaaaacccctaaagtagatgatggaagctcatctgagattaagttggccatcccagttttcttctttggcgttccttaccgcactgtctatgtcaataacaacggagttgtttccttcaatgtgctagtgagccagttcacgccagaatcctttcccctgacagatgggagagccttcgtcgccccattttgggcagatgtgcacaatggaattcgaggcgagatctattacagagagaccatggagcctgccatcttgaaaagagccaccaaggacatcaggaagtacttcaaagacatggcaaccttctctgccacttgggttttcattgtgacatgggaggaagtcacgttttatggaggcagcagcaccacacctgtgaacaccttccaggccgtcctagtgtccgatggctcctatacattcaccctcttcaattattacgaaatcaactggaccacggggacggcgagtggcggcgaccccctgacaggtcttggtggagtgatggcacaggcaggatttaatggtggaaacctcaccaatttcttcagcctcccggggtcaagaacccccgagatcgtgaatatccaggagaccacaaacgtcaatgttccaggccgctgggcatttaaagttgatggaaaggaaattgacccagccaatggctgcacctcaaggggacaattccttcggcgaggggaggtgttttgggatgacttgaactgcaccgtcaagtgccgctgtctggatttcaacaatgagatctactgccaggaggcttcctgtagcccctacgaggtgtgcgaacccaaaggcaaattcttctactgcagcgctgtggagaccagcacatgcgtggtgtttggggagccacactaccacacttttgacggcttcctcttccacttccaaggctcctgtgcctacttgctggcccgacagtgtttgcagacttccagcctccctttcttcagtgtggaggccaagaatgaacaccgcagaggttcagccgtctcctgggtgaaggagctctcagtggaggtgaatggctacaagattctcatccccaaaggaagctatggaagagtcaaggttaatgacctagtgacttctttgcctgtcaccttagacttggggacagtgaaaatctaccagagtggcatatctactgccgtggaaacagattttgggctcttagtgacttttgatggccagcactacgcctccatttccgtcccaggctcctatataaactccacctgtggactctgtggaaactataataaaaacccactggatgacttcctccgcccggatggcaggccggccatgtctgtcctggatctgggagagagctggcgtgtgtaccacgcagactggaagtgcgactccggctgcgtcgacaactgcacccagtgcgacgctgccactgaagccctctactttggctctgactactgcggcttcctcaacaagacagacggccctctgtgggagtgtggcactgtcgtggaccccactgcttttgtgcacagctgcgtgtatgacctgtgcagtgtgagggacaatggcacgctcctctgccaagccatccaggcctatgctcttgtgtgccaagcccttggcattccaattggagactggcgaacccagactgggtgtgtgtccacagtgcagtgcccgagcttcagccactactccgtgtgcacaagcagctgccccgacacatgctccgacctgacggcctcgcggaactgcgccacgccgtgcacagagggctgcgagtgcaaccagggcttcgtcctcagcaccagccagtgcgtccctctgcacaagtgcggctgcgacttcgacggccactactacaccatgggggagttcttctgggccacggccaactgcactgtgcaatgcctgtgcgaggagggcggggacgtctactgcttcaacaagacctgcggcagcggggaggtgtgcgccgtggaggacggctaccagggctgcttccccaagcgggagaccgtgtgcctgctcagccagaaccaggtgctgcacacctttgacggcgcctcctacgccttcccctccgagttctcctacaccctcctgaagacctgccctgagcgcccagagtacttggaaatcgacatcaacaagaagaagcccgatgcaggacctgcttggctgcggggacttcggatcctggtggccgaccaggaggtcaagataggaggcatcggggcttcggaagtcaagttgaatggtcaggaagtggaattgccttttttccatccttcggggaagctggaaatttatcgaaacaaaaacagtacgacagtggagtccaagggcgtggtgactgtccagtactcagacataggtctattgtacatccggctgtccaccacatacttcaattgcacagggggcttgtgcggcttctacaatgccaacgccagtgacgagttctgtctccccaacggcaagtgcacggacaacctggcagtgttcctggaaagctggacaactttcgaggagatctgcaatggagagtgtggggacctgctgaaggcctgcaacaatgactcggagctgctcaagttttatcgaagccgctccaggtgcggcatcatcaacgacccctccaacagctccttcctggagtgccatggggtggtgaacgtcactgcctattaccgcacctgccttttccgcctgtgccagagtgggggcaatgagtcagagctctgtgactctgtggcccggtatgcaagcgcctgcaagaatgcggacgtggaggtggggccctggcggacctatgacttctgcccactggagtgcccagagaacagccactttgaggagtgcatcacatgtacagagacctgtgagacccttaccctgggccccatctgcgtggatagctgctctgagggatgtcagtgtgatgagggctatgctctactgggcagccagtgtgtcacgcggagtgagtgtggctgcaactttgaggggcaccaacttgccaccaatgagaccttctgggtggacctggactgccagatcttctgctattgcagtggcacagacaacagggtccactgcgagaccattccctgcaaggatgatgagtactgcatggaggaaggtggcctgtactactgccaagcccgcaccgacgcctcctgcatcgtctcaggctacggccactacctcacctttgatggcttcccctttgacttccagaccagctgcccactcatcctgtgcaccacaggaagcaggccaagctcagactctttccccaagtttgttgtcacagccaagaatgaggaccgggacccgtcactggccttgtgggttaagcaggtggacgtgaccgtgtttggctacagcatcgtgatccaccgagcttacaagcacactgtgctggtcaacagtgaacggctctatctgcccctgaagctggggcaagggaagataaatatcttttcctttggcttccacgtggtggtggaaactgattttggcctgaaggttgtatatgactggaagaccttcctgtccatcacagtccctcggagcatgcagaacagcacctatggtctgtgtggccgctacaacggcaaccctgatgatgacctggagatgcccatgggtctgcttgcatcgagtgtcaatgagtttgggcagagctgggtgaagagggacaccttctgccaggtgggctgtggggaccgctgtccgtcctgtgccaaggtggaaggtttctccaaagtgcagcagctgtgcagcctgatccccaaccagaacgctgccttctccaagtgtcacagcaaagttaaccccaccttcttctataagaactgcctgtttgactcttgcatcgatgggggcgcggtgcagaccgcctgcagctggctgcagaactacgccagcacctgccagactcaggggattacggtgactggctggaggaattacacgtcctgcactgtcacctgccctccaaacagccattacgagagctgcgtgagtgtctgccagccccgctgcgccgccatccgcctgaagagtgactgcagccactactgcgtggagggctgtcactgcgacgctggctacgtcctcaacggcaagagctgcatcctgccccacagctgcggctgctactccgatggcaaatattacgagcccaagcagctattttggaacagcgactgcacgcggcgctgccgctgtttccgtcgcaacgtgattcagtgcgacccgcgccaatgcaagtcagacgaggagtgtgcgctgcgcaacggggtgcgcggctgcttcagcaccaagacctcctactgcctggcggccggcggcggcgtcttccgcaccttcgacggcgccttcctgcgcttcccagccaactgcgccttcgtgctgtccaccatctgccagaaactgcccgacatctccttccagcttatcatcaacttcgacaagtggtcggcccccaacctcaccatcatttcgcccgtctacttctacattaacgaagagcagattctcatcaacgaccggaacacggtcaaggtgaatggcacacaagtgaatgttccatttataactggtttggcaaccaaaatctacagcagtgaggggtttctggtgattgacaccagcccagacatccagatatactacaatggtttcaacgtcattaaaatcagcatcagcgagaggctgcagaacaaagtgtgcggtctctgtggcaacttcaacggggacctaacagatgattatgtgaccttgcgagggaagccggtggtaagcagcgtggtgctggcccagagctggaaaaccaatggcatgcagaagagacctcttgcccccagctgcaacgagctgcagttctcacagtatgcagccatgtgtgacaatgtgcacatccagaagatgcagggtgatggctactgcctgaagctcaccgacatgaagggcttcttccagccctgctatgggcttctcgatcccctcccattctacgagtcctgctacctggacggctgctacagccacaagaagttccagctgtgcggctccctggccgcctacggggaggcctgccgctccttcgggatccttagcaccgagtggattgagaaggagaattgctcaggagtggttgaagatccctgtgtgggggcggactgtcccaaccgaacttgcgagctgggcaatggcagggagctgtgtggctgcatcgagccacccccctatggaaataactcacatgacattatcgatgcagaggtgacctgcaaagcagcccaaatggaagtgtccatatctaagtgcaagctcttccagctcggttttgagagggagggcgtgaggatcaatgacagacagtgcaccggcatcgagggggaagattttatctcctttcagatcaacaacaccaaagggaattgtggaaacattgtgcagtccaatggcacgcatatcatgtataaaaacacactctggatcgaaagcgccaacaacactggcaacatcatcaccagggaccgcacgatcaatgtggaattttcatgtgcttatgagctggatatcaagatctccttggattctgttgtgaagcctatgctaagtgtaattaacctgacagttccaacccaagaaggcagcttcatcaccaagatggctctctacaaaaacgcctcctacaaacatccttaccgccagggtgaagtagtgttgacgactcgagatgtgctgtatgtaggggtttttgtggttggagctgacgccacacatttaatcctaacactcaacaaatgctatgccacacccacccgagatagcaatgataagctccgatatttcatcattgaaggagggtgtcagaacctcaaagataacaccattggcatcgaggagaatgcagtctccctgacctgtcgctttcacgtcaccgtctttaaattcataggggattacgacgaagttcaccttcactgtgcagtgtcactctgcgactcagaaaagtactcctgtaaaatcacttgcccacacaattccaggattgccacagattacacaaaagagcccaaagaacagatcatttcagtgggacctattaggagaaaaaggctggactggtgtgaggacaatggagggtgtgagcagatttgcacgagccgggtggatgggcctctctgcagctgtgtaacaggaaccctgcaggaggacggcaagagctgcagagcctctaattcttcaatggaacttcaagtctggacgcttcttctcatcatgatccagatttcattatggcattttgtctataaatcaggcacgacctcataa

SEQ ID NO: 31239 - DNA, 7426 bp, Homo sapiens
cgcaatcctgaaactgatctttagatttacttttccttaatcaatagaaaaaaacttgattgcagctcaacacttacctgtctctagtgcaggactaacttaatttttggttttaagagtacgagattcagacattatttcaggaatcagaaattattggcaacaagttgaggagaactgacatgaattcttgttttacctaattttttctggcttaccaagatttggcttaatatttctgactcagttcctccagcctctacagaacaggatgaattattcatcattccttagaatttgggtctctttcatcttcgcacttgtacagcaccaagctcagcccagggagctcatgtatccattttggcagaatgacaccaaaacccctaaagtagatgatggaagctcatctgagattaagttggccatcccagttttcttctttggcgttccttaccgcactgtctatgtcaataacaacggagttgtttccttcaatgtgctagtgagccagttcacgccagaatcctttcccctgacagatgggagagccttcgtcgccccattttgggcagatgtgcacaatggaattcgaggcgagatctattacagagagaccatggagcctgccatcttgaaaagagccaccaaggacatcaggaagtacttcaaagacatggcaaccttctctgccacttgggttttcattgtgacatgggaggaagtcacgttttatggaggcagcagcaccacacctgtgaacaccttccaggccgtcctagtgtccgatggctcctatacattcaccctcttcaattattacgaaatcaactggaccacggggacggcgagtggcggcgaccccctgacaggtcttggtggagtgatggcacaggcaggatttaatggtggaaacctcaccaatttcttcagcctcccggggtcaagaacccccgagatcgtgaatatccaggagaccacaaacgtcaatgttccaggccgctgggcatttaaagttgatggaaaggaaattgacccagccaatggctgcacctcaaggggacaattccttcggcgaggggaggtgttttgggatgacttgaactgcaccgtcaagtgccgctgtctggatttcaacaatgagatctactgccaggaggcttcctgtagcccctacgaggtgtgcgaacccaaaggcaaattcttctactgcagcgctgtggagaccagcacatgcgtggtgtttggggagccacactaccacacttttgacggcttcctcttccacttccaaggctcctgtgcctacttgctggcccgacagtgtttgcagacttccagcctccctttcttcagtgtggaggccaagaatgaacaccgcagaggttcagccgtctcctgggtgaaggagctctcagtggaggtgaatggctacaagattctcatccccaaaggaagctatggaagagtcaaggttaatgacctagtgacttctttgcctgtcaccttagacttggggacagtgaaaatctaccagagtggcatatctactgccgtggaaacagattttgggctcttagtgacttttgatggccagcactacgcctccatttccgtcccaggctcctatataaactccacctgtggactctgtggaaactataataaaaacccactggatgacttcctccgcccggatggcaggccggccatgtctgtcctggatctgggagagagctggcgtgtgtaccacgcagactggaagtgcgactccggctgcgtcgacaactgcacccagtgcgacgctgccactgaagccctctactttggctctgactactgcggcttcctcaacaagacagacggccctctgtgggagtgtggcactgtcgtggaccccactgcttttgtgcacagctgcgtgtatgacctgtgcagtgtgagggacaatggcacgctcctctgccaagccatccaggcctatgctcttgtgtgccaagcccttggcattccaattggagactggcgaacccagactgggtgtgtgtccacagtgcagtgcccgagcttcagccactactccgtgtgcacaagcagctgccccgacacatgctccgacctgacggcctcgcggaactgcgccacgccgtgcacagagggctgcgagtgcaaccagggcttcgtcctcagcaccagccagtgcgtccctctgcacaagtgcggctgcgacttcgacggccactactacaccatgggggagttcttctgggccacggccaactgcactgtgcaatgcctgtgcgaggagggcggggacgtctactgcttcaacaagacctgcggcagcggggaggtgtgcgccgtggaggacggctaccagggctgcttccccaagcgggagaccgtgtgcctgctcagccagaaccaggtgctgcacacctttgacggcgcctcctacgccttcccctccgagttctcctacaccctcctgaagacctgccctgagcgcccagagtacttggaaatcgacatcaacaagaagaagcccgatgcaggacctgcttggctgcggggacttcggatcctggtggccgaccaggaggtcaagataggaggcatcggggcttcggaagtcaagttgaatggtcaggaagtggaattgccttttttccatccttcggggaagctggaaatttatcgaaacaaaaacagtacgacagtggagtccaagggcgtggtgactgtccagtactcagacataggtctattgtacatccggctgtccaccacatacttcaattgcacagggggcttgtgcggcttctacaatgccaacgccagtgacgagttctgtctccccaacggcaagtgcacggacaacctggcagtgttcctggaaagctggacaactttcgaggagatctgcaatggagagtgtggggacctgctgaaggcctgcaacaatgactcggagctgctcaagttttatcgaagccgctccaggtgcggcatcatcaacgacccctccaacagctccttcctggagtgccatggggtggtgaacgtcactgcctattaccgcacctgccttttccgcctgtgccagagtgggggcaatgagtcagagctctgtgactctgtggcccggtatgcaagcgcctgcaagaatgcggacgtggaggtggggccctggcggacctatgacttctgcccactggagtgcccagagaacagccactttgaggagtgcatcacatgtacagagacctgtgagacccttaccctgggccccatctgcgtggatagctgctctgagggatgtcagtgtgatgagggctatgctctactgggcagccagtgtgtcacgcggagtgagtgtggctgcaactttgaggggcaccaacttgccaccaatgagaccttctgggtggacctggactgccagatcttctgctattgcagtggcacagacaacagggtccactgcgagaccattccctgcaaggatgatgagtactgcatggaggaaggtggcctgtactactgccaagcccgcaccgacgcctcctgcatcgtctcaggctacggccactacctcacctttgatggcttcccctttgacttccagaccagctgcccactcatcctgtgcaccacaggaagcaggccaagctcagactctttccccaagtttgttgtcacagccaagaatgaggaccgggacccgtcactggccttgtgggttaagcaggtggacgtgaccgtgtttggctacagcatcgtgatccaccgagcttacaagcacactgtgctggtcaacagtgaacggctctatctgcccctgaagctggggcaagggaagataaatatcttttcctttggcttccacgtggtggtggaaactgattttggcctgaaggttgtatatgactggaagaccttcctgtccatcacagtccctcggagcatgcagaacagcacctatggtctgtgtggccgctacaacggcaaccctgatgatgacctggagatgcccatgggtctgcttgcatcgagtgtcaatgagtttgggcagagctgggtgaagagggacaccttctgccaggtgggctgtggggaccgctgtccgtcctgtgccaaggtggaaggtttctccaaagtgcagcagctgtgcagcctgatccccaaccagaacgctgccttctccaagtgtcacagcaaagttaaccccaccttcttctataagaactgcctgtttgactcttgcatcgatgggggcgcggtgcagaccgcctgcagctggctgcagaactacgccagcacctgccagactcaggggattacggtgactggctggaggaattacacgtcctgcactgtcacctgccctccaaacagccattacgagagctgcgtgagtgtctgccagccccgctgcgccgccatccgcctgaagagtgactgcagccactactgcgtggagggctgtcactgcgacgctggctacgtcctcaacggcaagagctgcatcctgccccacagctgcggctgctactccgatggcaaatattacgagcccaagcagctattttggaacagcgactgcacgcggcgctgccgctgtttccgtcgcaacgtgattcagtgcgacccgcgccaatgcaagtcagacgaggagtgtgcgctgcgcaacggggtgcgcggctgcttcagcaccaagacctcctactgcctggcggccggcggcggcgtcttccgcaccttcgacggcgccttcctgcgcttcccagccaactgcgccttcgtgctgtccaccatctgccagaaactgcccgacatctccttccagcttatcatcaacttcgacaagtggtcggcccccaacctcaccatcatttcgcccgtctacttctacattaacgaagagcagattctcatcaacgaccggaacacggtcaaggtgaatggcacacaagtgaatgttccatttataactggtttggcaaccaaaatctacagcagtgaggggtttctggtgattgacaccagcccagacatccagatatactacaatggtttcaacgtcattaaaatcagcatcagcgagaggctgcagaacaaagtgtgcggtctctgtggcaacttcaacggggacctaacagatgattatgtgaccttgcgagggaagccggtggtaagcagcgtggtgctggcccagagctggaaaaccaatggcatgcagaagagacctcttgcccccagctgcaacgagctgcagttctcacagtatgcagccatgtgtgacaatgtgcacatccagaagatgcagggtgatggctactgcctgaagctcaccgacatgaagggcttcttccagccctgctatgggcttctcgatcccctcccattctacgagtcctgctacctggacggctgctacagccacaagaagttccagctgtgcggctccctggccgcctacggggaggcctgccgctccttcgggatccttagcaccgagtggattgagaaggagaattgctcaggagtggttgaagatccctgtgtgggggcggactgtcccaaccgaacttgcgagctgggcaatggcagggagctgtgtggctgcatcgagccacccccctatggaaataactcacatgacattatcgatgcagaggtgacctgcaaagcagcccaaatggaagtgtccatatctaagtgcaagctcttccagctcggttttgagagggagggcgtgaggatcaatgacagacagtgcaccggcatcgagggggaagattttatctcctttcagatcaacaacaccaaagggaattgtggaaacattgtgcagtccaatggcacgcatatcatgtataaaaacacactctggatcgaaagcgccaacaacactggcaacatcatcaccagggaccgcacgatcaatgtggaattttcatgtgcttatgagctggatatcaagatctccttggattctgttgtgaagcctatgctaagtgtaattaacctgacagttccaacccaagaaggcagcttcatcaccaagatggctctctacaaaaacgcctcctacaaacatccttaccgccagggtgaagtagtgttgacgactcgagatgtgctgtatgtaggggtttttgtggttggagctgacgccacacatttaatcctaacactcaacaaatgctatgccacacccacccgagatagcaatgataagctccgatatttcatcattgaaggagggtgtcagaacctcaaagataacaccattggcatcgaggagaatgcagtctccctgacctgtcgctttcacgtcaccgtctttaaattcataggggattacgacgaagttcaccttcactgtgcagtgtcactctgcgactcagaaaagtactcctgtaaaatcacttgcccacacaattccaggattgccacagattacacaaaagagcccaaagaacagatcatttcagtgggacctattaggagaaaaaggctggactggtgtgaggacaatggagggtgtgagcagatttgcacgagccgggtggatgggcctctctgcagctgtgtaacaggaaccctgcaggaggacggcaagagctgcagagcctctaattcttcaatggaacttcaagtctggacgcttcttctcatcatgatccagatttcattatggcattttgtctataaatcaggcacgacctcataattaactcaaggttgctatataaagtactgtaatttacttacttcaacaccctgtaggataaaaagtgtgtgcccttaagtcaaaacctatttgaaagtgtccagcatctcaaaatgatgccacctgcctccaatggtccaaggtccagaaaccagcgaccatccaagctcctctttcagagtatgaaacggggcttctacaagccagttatggaaagtatctctcttgtgtaaaattcccaaacagttgtcactagagactttggttcacatgaaaaaccagtaaaggaaaaaaattctggttagagaaatctgactggaaatctgaccagagaaatctgtcaagccagtgctatttctggatcacagttttttacagagagagggcctgttggaacgattttgaagtgatgactggaaggtttgactccctctaaggaatcttgctggtgtttggaagtgtccgatctacgttatgcacgtgttctgtctatgaggcgcttctccacccactgtgtccttcaaccttgccatggcagctttggccactggggatattgttgacctggggaaccccacccactctcctaccccctcgaacccaatcccttctctttttacaaatcaaccaaatactttttaatgtgttttatccttaaataaactttgtgttcaagtattctcatta

SEQ ID NO: 31240 - DNA, 3421 bp, Homo sapiens
gttgtcatggagaccgcgttgtttacctctctgttctgcaagagctggaagctccagttggggtaaggaggctcccatcccgagcttgcgtagtggttctgtgtggcgctgaggaatttggaaacctcaaatggctaaactattacaacctccacccaagttcctgccctcagagtggcacattgctaacaagaaccagtaccacagagcagacgctcaaaggtcccgatcagaacgcctggtcgcagaaagccagaggcttgtggatgaaattgaaaagaccacaagaaaatctcaaagcgatgtgaacaagaaactagaacagagactcgaggaagtccagttctggaagaaggagttagatgacaaacttgagcagcttgtgaatgtaactgatgatctactcatatataagatcagattggaaaaagccctggagaccttgaaagagcccttgcacatcactgagacatgcctggcatacagggagaagcgcattggcattgacctggtgcacgacacagtggagcatgagctgataaaggaggctgagatcatccagggcattatggctctgctgacccgtaccttggaggaggcttccgagcagattcggatgaaccgctctgccaagtacaatcttgagaaggatttgaaggacaagtttgtggccctgaccatagatgatatctgcttctcgctcaacaacaactcaccaaacatcagatattctgagaacgccgtgaggattgagccaaactccgtgagtctggaagactggttggacttctccagcaccaatgtggagaaggctgacaagcagcggaacaactccctgatgctgaaagccctggtggatcgaatcctgtcccagacagccaatgatctgcgcaagcagtgtgatgtggtggacacggcattcaagaatgggctgaaggatacaaaggatgccagggacaagctggctgatcatctggccaaggtcatggaagagattgcttcccaggagaaaaatattacagctcttgaaaaggccatccttgaccaagaagggccagccaaggtggctcatacgcgcttggagaccaggacacaccggccgaacgtggagctgtgtcgtgatgtcgcacaatataggctaatgaaggaggttcaagagatcacccacaatgtcgcaagattgaaggaaactttagcccaagctcaggcagagctgaaagggctgcatcgcagacagcttgccctgcaggaggagatccaggtcaaagagaacaccatttatatcgacgaagtgctgtgtatgcagatgaggaaatccatcccacttcgggatggggaagaccatggggtctgggctgggggcctccgccctgatgctgtctgctaatagtagggctagttccaattctcattaaaccacattgtaaacagtagttacagtagtacagagctctcatttcaggctggcggggcctctagccagcctgctgcaacctcttggctggcattccaagcctgctcagggggctgattttggggcgagtttcttctcttatgctggtgtggtgtttgcctaacaattcaactccatattttagcacaggccactcttacaatatcacaggacttggggccccaggacagggtttcaagacatttcagttcagattcaattcaataaagtagttgggctggatcacctgtgtagaccatgcccctcttgctcatgagatgggatgctaacctttctcttggctctcaaaatttcttttctctagaaaataatgtgttttttttctcttaaatactcaaataacataaagaaaaagaacaaaattccattcattcaagtcaatgggttcaagtcaatggttaagactgtaggttccggagtctgccatctgagtataggacctccaatagtccccactcacagggctataggggcgttgaatgagatcacctccgtaaagggcttcatactgagcctgtatcatggggcagtgagtgtttaatgaatgtgagccattgtgagcagtcccaccctataccaacataatttctgcacaattgtactcatggcataaactcaatttcaggattatttttttccttcactgctaattattgcaagcctttgttcatgttgctaaattgtctttataattattttaatggttacgtacctctttacaagttttcagcaagactgttttatatacttactgtttcttttccaaaaagagttcaacttgtgggaggctgccttccgctgagctgcagcaggtcagagatctatgtgggtgactgtcaaaggaagacatttgctgtgggaaactgctcatttgttccttattccgctaacattgaaggaacactttccatggacgaggcttaccatctcagcaccctcccatgtgtgaagctgctgctacactctgctaacatttggttccccggtgctcatggacagctgacggtgtggggctcaggagacctagcttctagttgcaacactgccaggaaagtttctctccttctttaggaccacctgtaaagtaaggaaaggactatatcgtctggaactcttcctgtccttgctgttccctgaatctggctgtctagctgcacatacggtgtcatagggcacaatgataatgcagagtgtgggcctaattcctgggagctttgcaatctaggtgctccttggtccagagactctttgccatcagaaagggatgttcccaatctgggatggagaaaccccctttgaggccaaaagcactggcttaattctgttaattctgatctatgccaccccagtgctgaacgtctcctctcagagtgctcagcaaatacacagcccttcccatgcctcaatcaaggagggaggcccctctctgctcactgggaagcctctgggtgcttttctgctctggctcggaagagtccaaataagccttcccagctcactgggcagacctcagagtttctgctaacttagcagggttttgaggtctgtcccagaggatgtggctggcagggtgtgaagacactgggcaaaatccttccttgtgaatacagctctcagaggcagccagcctcagtggtggattcagatcccaggctctgcagggagatgtgattcagatcagctggtggatcagctccacgctctacctgtgatgtgatccccgccaagttactcaacttccccgagcttcagttgcctaatctgtaaataagactaataaagcctagattggcgagataacgtgtggaagactctcaacacagtgtctggaacatgctgcttttaagggaaatgtgattttgattatggttgaggccatttctcaacatgtagacataaaatgcggaaacatctaagatttcaataaagcaatgttttgttagtaaa

SEQ ID NO: 31241 - DNA, 1532 bp, Homo sapiens
agttggggtaaggaggctcccatcccgagcttgcgtagtggttctgtgtggcgctgaggaatttggaaacctcaaatggctaaactattacaacctccacccaagttcctgccctcagagtggcacattgctaacaagaaccagtaccacagagcagacgctcaaaggtcccgatcagaacgcctggtcgcagaaagccagaggcttgtggatgaaattgaaaagaccacaagaaaatctcaaagcgatgtgaacaagaaactagggagaagcgcattggcattgacctggtgcacgacacagtggagcatgagctgataaaggaggctgagatcatccagggcattatggctctgctgacccgtaccttggaggaggcttccgagcagattcggatgaaccgctctgccaagtacaatcttgagaaggatttgaaggacaagtttgtggccctgaccatagatgatatctgcttctcgctcaacaacaactcaccaaacatcagatattctgagaacgccgtgaggattgagccaaactccgtgagtctggaagactggttggacttctccagcaccaatgtggagaaggctgacaagcagcggaacaactccctgatgctgaaagccctggtggatcgaatcctgtcccagacagccaatgatctgcgcaagcagtgtgatgtggtggacacggcattcaagaatgggctgaaggatacaaaggatgccagggacaagctggctgatcatctggccaaggtcatggaagagattgcttcccaggagaaaaatattacagctcttgaaaaggccatccttgaccaagaagggccagccaaggtggctcatacgcgcttggagaccaggacacaccggccgaacgtggagctgtgtcgtgatgtcgcacaatataggctaatgaaggaggttcaagagatcacccacaatgtcgcaagattgaaggaaactttagcccaagctcaggcagagctgaaagggctgcatcgcagacagcttgccctgcaggaggagatccaggtcaaagagaacaccatttatatcgacgaagtgctgtgtatgcagatgaggaaatccatcccacttcgggatggggaagaccatggggtctgggctgggggcctccgccctgatgctgtctgctaatagtagggctagttccaattctcattaaaccacattgtaaacagtagttacagtagtacagagctctcatttcaggctggcggggcctctagccagcctgctgcaacctcttggctggcattccaagcctgctcagggggctgattttggggcgagtttcttctcttatgctggtgtggtgtttgcctaacaattcaactccatattttagcacaggccactcttacaatatcacaggacttggggccccaggacagggtttcaagacatttcagttcagattcaattcaataaagtagttgggctggatcacctgtgtagaccatgcccctcttgctcatgagatgggatgctaacctttctctt

SEQ ID NO: 31242 - DNA, 1694 bp, Homo sapiens
gtggtaggctgcgaccccttcctcccacagccccttcccgcccctcgccgggcatccgccgacagaacaggagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccctttgtttccaacagaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggcagacacaacccaaaatctgggagaacgtgtcaatgacatagggttttggaaatctgaaatcattcatgagttggatgaaatgattggagagacaaatgcacttactgatgtgaagaaaagactggagcgggctttgatggagactgaagcccctcttcaggtagcccgagaatgtctatttcatcgagaaaagagaatgggaatcgacctagttcacgatgaagttgaagcacaactgctgacggaagttgatactattctgtgttgtcaagaaagaatgaagctacatttggataaggctattgcccaacttgcagccaacagagcgtcccagcatgagctggaaaaggacctgagtgacaaacagacggcttaccggatcgacgacaaatgccaccacctgcgcaacacatcagacggtgtcggctacttccgcggagtggagagggtcgatgcaactgtctcagtgcctgagtcctgggccaaatttacagatgacaatattctccgctcccagagtgaacgggcagcttccgctaagctaagagacgacattgaaaacctcttggttgtgactgccaatgagatgtggaatcaattcaacaaagtgaacttgtctttcaccaatcgcattgctgagactgcagatgctaagaataagattcagacgcacttagcaaagaccctgcaggagattttccagactgaaatgaccatagaatccatcaagaaggccatcaaggacaagactgccttcctgaaggtggctcagaccagactggatgagcgcacaagacggccgaacattgagttgtgccgagacatggctcagctacgccttgttaacgaggtacacgaggttgacgacaccatccagaccctgcagcagcgcctgagggatgcagaggacaccctgcagtcgctggtccacatcaaagccacactcgagtatgacctggctgtcaaagccaattccctgtacatcgaccaggaaaaatgcatgagcatgcgcaagagctaccccaacaccctccggctggtcggcttctgctagggaccccaccgggtgtggttttgatacccctaagttaaggctgagccagagcactgtctcagcatttgaaccgaatgctaatatagtcacttattaaaggattatgctgatggaaatgtacc

SEQ ID NO: 31243 - DNA, 1785 bp, Homo sapiens
acagataggaaaggcggggccagggccagactggtctgggccccagtcgagggctgcaggtggtaggctgcgaccccttcctcccacagccccttcccgcccctcgccgggcatccgccgacaggtacataccaagaaattgaattgctgagtcacaggagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccctttgtttccaacagaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggcagacacaacccaaaatctgggagaacgtgtcaatgacatagggttttggaaatctgaaatcattcatgagttggatgaaatgattggagagacaaatgcacttactgatgtgaagaaaagactggagcgggctttgatggagactgaagcccctcttcaggtagcccgagaatgtctatttcatcgagaaaagagaatgggaatcgacctagttcacgatgaagttgaagcacaactgctgacggaagttgatactattctgtgttgtcaagaaagaatgaagctacatttggataaggctattgcccaacttgcagccaacagagcgtcccagcatgagctggaaaaggacctgagtgacaaacagacggcttaccggatcgacgacaaatgccaccacctgcgcaacacatcagacggtgtcggctacttccgcggagtggagagggtcgatgcaactgtctcagtgcctgagtcctgggccaaatttacagatgacaatattctccgctcccagagtgaacgggcagcttccgctaagctaagagacgacattgaaaacctcttggttgtgactgccaatgagatgtggaatcaattcaacaaagtgaacttgtctttcaccaatcgcattgctgagactgcagatgctaagaataagattcagacgcacttagcaaagaccctgcaggagattttccagactgaaatgaccatagaatccatcaagaaggccatcaaggacaagactgccttcctgaaggtggctcagaccagactggatgagcgcacaagacggccgaacattgagttgtgccgagacatggctcagctacgccttgttaacgaggtacacgaggttgacgacaccatccagaccctgcagcagcgcctgagggatgcagaggacaccctgcagtcgctggtccacatcaaagccacactcgagtatgacctggctgtcaaagccaattccctgtacatcgaccaggaaaaatgcatgagcatgcgcaagagctaccccaacaccctccggctggtcggcttctgctagggaccccaccgggtgtggttttgatacccctaagttaaggctgagccagagcactgtctcagcatttgaaccgaatgctaatatagtcacttattaaaggattatgctgatggaaatgtaccaac

SEQ ID NO: 31244 - DNA, 583 bp, Homo sapiens
actccagcctgggggacagagcgagactccatctcaaaaaaaaaaaaaagaattgactgagttagaatttagagagtaagttaatcattgtgaaagatgcgcaccaccaaagagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccctttgtttccaacagaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggcagacacaacccaaaatctgggaga

SEQ ID NO: 31245 - DNA, 564 bp, Homo sapiens
aaaggcggggccagggccagactggtctgggccccagtcgagggctgcaggtggtaggctgcgaccccttcctcccacagccccttcccgcccctcgccgggcatccgccgacaggagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccctttgtttccaacagaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggca

SEQ ID NO: 31246 - DNA, 483 bp, Homo sapiens
gagggctgcaggtggtaggctgcgaccccttcctcccacagccccttcccgcccctcgccgggcatccgccgacaggctggagtgcaatggcatgatctcagctcaccggaacctccgcctcccagattcaagcgattctcctgcctcagccccctgagtagctgggattacaggtacataccaagaaattgaattgctgagtcacaggagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccc

SEQ ID NO: 31247 - DNA, 3253 bp, Homo sapiens
cgccccagaggctcaagaaaacccgcgggagcctcgcccggacccaggaactcgtgctcggggccaaccggctgggccgcgatcgcgtttcgtccggggccgcggcggccgtggggaatcggctgcagcgaatcggtggcgcgcggcgcctgagcgcgctgcagtcacccgggagccgggtccaggtcgtcttcccgtgacgcccagatctgtcctgcaggatggagccagcaccctcagaggttcgactcgccgtccgggaagccattcatgccctctcgtcttcggaggatggcggccacatcttctgcaccctggagtccctgaagcggtatctcggtgagatggagcctccagcgctcccgagggagaaggaggagtttgcctcggcccacttctcgcctgtcctcagatgtcttgccagcaggctgagcccagcctggctggagctgctgccccatggccgcctggaggagctgtgggccagcttcttcctggagggcccggcggaccaagccttcctggtgttgatggagaccatcgagggtgctgcgggccccagcttccggctgatgaagatggcgcggctgctggccagattcctgcgcgagggccggctggcagtgctgatggaggcgcagtgtcggcagcagacgcagcccggcttcatcctgctccgggagacgctgctgggcaaggtggtggccctgcccgatcacctgggcaaccgcctgcagcaggagaacttggccgagttcttcccccagaactacttccgcctgctcggcgaggaggtcgtccgggtgctgcaggcggttgtggactctctccaaggtggcctggattcctccgtgtccttcgtgtctcaggtccttgggaaagcctgtgtccacgggaggcagcaggagatcctgggcgtgctggtaccccggctggcagcgctcacccagggcagctacctgcaccagcgcgtctgctggcgcctggtggagcaagtgccggaccgggccatggaggctgtgctgaccgggctggtggaggccgcactggggcctgaggtcctttcgagactgctggggaacctggtggtgaagaacaagaaggcccagtttgtgatgacccagaagcttctgttcttacagtcccggctcacgacgcccatgctgcagagcctgctgggccatctggccatggacagccagcggcgcccgctcctgctgcaggtgctgaaggagctgttggagacgtggggcagcagcagtgccatccgccacactcccctgccgcagcagcgccacgtcagcaaggctgtcctcatctgcctggcgcaactcggggagccggaactgcgggacagccgggatgaactgctggccagcatgatggcgggcgtgaagtgccgcctggacagtagcctgccccccgtgcgacgcctgggcatgatcgtggcagaggtcgttagtgcccggatccaccccgaggggcctcccctgaaattccagtacgaagaggatgaactgagcctcgagctgctggccttggcctccccccagcctgcgggtgacggcgcctcggaggcgggcacgtccctcgttccagccacggcagagccccctgcagagacccccgcagagatcgtggatggcggcgtcccccaagcacagctggcgggctctgactcggacctggacagcgatgatgagtttgtcccctacgacatgtcgggggacagagagctgaagagcagcaaggctcctgcctacgtccgggactgcgtggaagccctgaccacgtctgaggacatagagcgctgggaggcagccctgcgggcccttgagggcctggtctacaggagccccacagccactcgggaggtgagcgtggagctggccaaggtgcttctgcatctggaggagaagacctgtgtggtgggatttgcagggctgcgccagagagccctggtggccgtcacggtcacagacccggccccggtggccgactatctgacctcacagttctatgccctcaactacagcctccggcagcgcatggacatcctggatgtgctgactctggctgcccaggagctgtctaggcctgggtgcctcgggaggactccccaacctggctccccaagtcccaacaccccgtgcctgccagaggcagccgtctctcagcctggcagtgccgtggcgtctgactggcgggtggtggtggaggagcggatcagaagcaagacccagcggctctccaagggtggcccgaggcagggcccggcaggcagccccagcagattcaactccgtggccggccacttcttcttccccctccttcagcgctttgacaggcctctggtgaccttcgacctcttgggagaagaccagctggttctcggaaggctggcgcacaccttaggggccctgatgtgcctggctgttaacaccacggtggctgtggccatgggcaaggccctgctggaattcgtgtgggcccttcgcttccacatcgatgcctacgtgcgccaggggctgttgtcggccgtctcctccgtcctgctcagcctgcctgctgcgcgcctgctggaggacctgatggacgagctgctggaagcccggtcctggctggcggacgtggctgagaaagacccggacgaggactgcaggacgctggcactgagggccctgctgcttctgcagagactcaagaacaggctcctcccacccgcgtctccctagtccctggaggcctccccaggaccaccctcgccgacagcaaggcaggcggctgagcagcggcctggagcagcagagccaggctttgtagcgaggccaggtcttcggccgcatccggtacggagagtgcagatgcaggaaggcccggcctgccgctatttatagtgcagccagtccgctaaaaatacactgggcctgggcactgcccgccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtggctcctggatgggctcgtggggcgggatgggacagggcacgggctctcagaaaataaactgctttattggaa

SEQ ID NO: 31248 - DNA, 3036 bp, Homo sapiens
gatgcgccctcccgcctggcgtcctccgcagattcgcgctgagaggcccgcggagacccgccccagaggctcaagaaaacccgcgggagcctcgcccggacccaggaactcgtgctcggggccaaccggctgggccgcgatcgcgtttcgtccggggccgcggcggccgtggggaatcggctgcagcgaatcggtggcgcgcggcgcctgagcgcgctgcagtcacccgggagccgggtccaggtcgtcttcccgtgacgcccagatctgtcctgcaggatggagccagcaccctcagaggttcgactcgccgtccgggaagccattcatgccctctcgtcttcggaggatggcggccacatcttctgcaccctggagtccctgaagcggtatctcggtgagatggagcctccagcgctcccgagggagaaggaggagtttgcctcggcccacttctcgcctgtcctcagatgtcttgccagcaggctgagcccagcctggctggagctgctgccccatggccgcctggaggagctgtgggccagcttcttcctggagggcccggcggaccaagccttcctggtgttgatggagaccatcgagggtgctgcgggccccagcttccggctgatgaagatggcgcggctgctggccagattcctgcgcgagggccggctggcagtgctgatggaggcgcagtgtcggcagcagacgcagcccggcttcatcctgctccgggagacgctgctgggcaaggtggtggccctgcccgatcacctgggcaaccgcctgcagcaggagaacttggccgagttcttcccccagaactacttccgcctgctcggcgaggaggtcgtccgggtgctgcaggcggttgtggactctctccaaggtggcctggattcctccgtgtccttcgtgtctcaggtccttgggaaagcctgtgtccacgggaggcagcaggagatcctgggcgtgctggtaccccggctggcagcgctcacccagggcagctacctgcaccagcgcgtctgctggcgcctggtggagcaagtgccggaccgggccatggaggctgtgctgaccgggctggtggaggccgcactggggcctgaggtcctttcgagactgctggggaacctggtggtgaagaacaagaaggcccagtttgtgatgacccagaagcttctgttcttacagtcccggctcacgacgcccatgctgcagagcctgctgggccatctggccatggacagccagcggcgcccgctcctgctgcaggtgctgaaggagctgttggagacgtggggcagcagcagtgccatccgccacactcccctgccgcagcagcgccacgtcagcaaggctgtcctcatctgcctggcgcaactcggggagccggaactgcgggacagccgggatgaactgctggccagcatgatggcgggcgtgaagtgccgcctggacagtagcctgccccccgtgcgacgcctgggcatgatcgtggcagaggtcgttagtgcccggatccaccccgaggggcctcccctgaaattccagtacgaagaggatgaactgagcctcgagctgctggccttggcctccccccagcctgcgggtgacggcgcctcggaggcgggcacgtccctcgttccagccacggcagagccccctgcagagacccccgcagagatcgtggatggcggcgtcccccaagcacagctggcgggctctgactcggacctggacagcgatgatgagtttgtcccctacgacatgtcgggggacagagagctgaagagcagcaaggctcctgcctacgtccgggactgcgtggaagtcctggatgtgctgactctggctgcccaggagctgtctaggcctgggtgcctcgggaggactccccaacctggctccccaagtcccaacaccccgtgcctgccagaggcagccgtctctcagcctggcagtgccgtggcgtctgactggcgggtggtggtggaggagcggatcagaagcaagacccagcggctctccaagggtggcccgaggcagggcccggcaggcagccccagcagattcaactccgtggccggccacttcttcttccccctccttcagcgctttgacaggcctctggtgaccttcgacctcttgggagaagaccagctggttctcggaaggctggcgcacaccttaggggccctgatgtgcctggctgttaacaccacggtggctgtggccatgggcaaggccctgctggaattcgtgtgggcccttcgcttccacatcgatgcctacgtgcgccaggggctgttgtcggccgtctcctccgtcctgctcagcctgcctgctgcgcgcctgctggaggacctgatggacgagctgctggaagcccggtcctggctggcggacgtggctgagaaagacccggacgaggactgcaggacgctggcactgagggccctgctgcttctgcagagactcaagaacaggctcctcccacccgcgtctccctagtccctggaggcctccccaggaccaccctcgccgacagcaaggcaggcggctgagcagcggcctggagcagcagagccaggctttgtagcgaggccaggtcttcggccgcatccggtacggagagtgcagatgcaggaaggcccggcctgccgctatttatagtgcagccagtccgctaaaaatacactgggcctgggcactgcccgccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtggctcctggatgggctcgtggggcgggatgggacagggcacgggctctcagaaaataaactgctttattgg

SEQ ID NO: 31249 - DNA, 3825 bp, Homo sapiens
acttagcgcgtcacttccggcgaggcagaggaggcgggagagtgagagaaaggctggaagacgagcctgcaggatgtttcctcaatgaggggaaggctgctgcacaatggcagtttttgatactcctgaggaggcctttggtgtcttacgtccagtctgtgttcagctcacaaagacccagacagtggagaatgtggagcatctgcagacacgactacaagctgtgagtgacagtgcccttcaggaacttcagcagtacatcctcttccctctgcgatttaccctgaagaccccaggtcccaaaagagagcgtttgatccaaagtgtggtggaatgcctcacatttgtcctttcttcaacatgtgtgaaagaacaggagcttctccaggaactcttttcagaactctctgcttgtctgtattcacccagctcccaaaaacctgcggctgtgtccgaggagttgaaattggctgtgatccagggacttagcacattaatgcactcagcttatggggacatcattctgactttttatgagccctccattctgccacgtttaggatttgctgtatctttactgttaggccttgcagaacaggagaaatcaaagcaaattaaaattgctgccttaaaatgtttacaggttctactcttgcagtgtgattgtcaggaccatccaaggtcattggatgaacttgaacaaaagcagctgggggatttgtttgcctcttttttacctggaatctcaactgcactgaccaggcttatcacaggagactttaaacaaggtcacagcattgtcgtatcttccctaaagatcttttacaagacagtgagcttcattatggctgatgaacagctcaaaagaatctcaaaggtccaagcaaaacctgcagttgagcacagagtagcagagctgatggtttacagggaagcagattgggtaaaaaagactggcgacaagttgactatccttattaaaaagataattgagtgtgtttctgttcacccacactggaaggtgagactggaactggtagaacttgtggaggaccttcttttgaagtgcagtcaatcattggtcgaatgtgctggtccccttctgaaggccttagtgggactagtaaatgatgagagtcctgaaatccaagcccagtgcaataaagttctgagacattttgcagatcaaaaagtagtggtgggcaacaaagccctcgctgacatcttgtcagaaagcctgcattcccttgccacatctcttcctcgcctaatgaactcccaagatgaccagggcaaattctctactctttccttgttacttggttatctgaaactcttgggcccaaaaataaactttgtcctcaactctgtggcccatctccagcggctttccaaagcactcatccaagttctagagctagacgtggctgacatcaagattgttgaggaacggcgttggaactctgatgatctgaatgcttctccaaagacctcagccacacagccttggaaccgcatccagaggagatatttccgcttcttcactgatgagagaatcttcatgctcttgaggcaggtttgtcagctacttggttattatgggaatctttatttgcttgtggatcactttatggaactttaccatcaatctgtggtttaccggaagcaagctgccatgatccttaatgaactggttacaggggctgctgggctggaggttgaggatcttcacgaaaaacatattaaaacaaacccagaagaactgagagagattgtgacatctatacttgaagaatacacaagtcaagaaaattggtatttggttacctgtcttgaaactgaggaaatgggagaggagctgatgatggagcacccaggcctccaagccatcacgtctggtgaacacacctgccaagttacatcttttctagccttctcaaagccaagtcccactatttgctccatgaacagtaacatctggcaaatatgcattcagttggaaggaattggccagtttgcatatgcactaggaaaagacttctgtttgctcttgatgtcagccctttatccagtactggagaaggctggagaccaaaccctactcattagtcaggtggctaccagcaccatgatggacgtttgccgtgcttgtggctacgactccctgcagcacctgatcaatcaaaattcagactatttagtgaatgggatctctttaaatctgcgtcatctggctctgcatcctcataccccaaaggtcctggaagtcatgctgcggaactcagatgctaacctgcttcctttggtggcagatgtggttcaagatgtcttggccaccctggaccaattttacgataagagagctgcttcctttgtcagcgttctgcatgctctgatggcagcattagcccagtggttcccagacacaggtaatcttgggcacctccaagagcaaagtttaggagaagagggaagtcatttgaaccaaagaccagcagctcttgagaagagcaccaccacagctgaagacatcgaacagtttttgctgaactacctcaaagagaaggatgtggcagatggaaatgtctcggattttgataatgaagaagaggaacagtcagtccctcccaaagtggatgagaatgacacccgtccagatgtggagccaccactgccattgcagatccaaatagccatggacgtgatggaacgctgcatccacttgttgtcagataaaaatctgcaaatccgcctgaaggtcttggatgtgctggatctgtgtgtggttgttcttcagtcccacaaaaaccagctgcttcccttggctcatcaggcctggccctcgctcgttcaccgactcacacgggacgcccccctggcagtgcttagagccttcaaggttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgagggtgacctgaataaagtggctgatgcctgcttgatttacctcagtgtcaaacagcccgtgaaattacaagaggctgccaggagcgtcttcctccacttgatgaaggtggacccagactccacctggttcctcctgaacgagctttactgccccgtgcagttcacacctccccaccccagcctccaccctgtgcagctgcacggggccagcgggcagcagaacccctacacgaccaacgtgctccagctgctcaaggagctgcagtgaccctgctcccccaccacagaggccaccgatccctcccctactgccagccagaagctgggctgaccccaccccggccataggcggtggcagcggcagcagagaaggtgaattagttagccaatcgatttataaattgatcgatcacacaactgcttagaaatggattgaaggaaagtagctgactattatttatgtttcataccttgtgttgtcaagtgacattgtctggtggctctaagggtttaaccccttagcctaccatctctatagccccagctccctcacaggccacacacacacacacacaagaggtcagttcccctccatctgcatacacctccctgtcttcaaataatgagatggaactaatttgttttacctaacctgatctttgggaaacaaacggaaataaagacacttcttggatgaaaagtatgatcaaaagctca

SEQ ID NO: 31250 - DNA, 3958 bp, Homo sapiens
gcgtcacttccggcgaggcagaggaggcgggagagtgagagaaaggctggaagacgagacctgctcactctgtcaccgaggctagagtacagtggcacaatcacagctcattgcagcctcaacctcccaggctcaatcgatccttccaactgagcctccctagcagctgggactattagtgcacaccaccacacctagcctgcaggatgtttcctcaatgaggggaaggctgctgcacaatggcagtttttgatactcctgaggaggcctttggtgtcttacgtccagtctgtgttcagctcacaaagacccagacagtggagaatgtggagcatctgcagacacgactacaagctgtgagtgacagtgcccttcaggaacttcagcagtacatcctcttccctctgcgatttaccctgaagaccccaggtcccaaaagagagcgtttgatccaaagtgtggtggaatgcctcacatttgtcctttcttcaacatgtgtgaaagaacaggagcttctccaggaactcttttcagaactctctgcttgtctgtattcacccagctcccaaaaacctgcggctgtgtccgaggagttgaaattggctgtgatccagggacttagcacattaatgcactcagcttatggggacatcattctgactttttatgagccctccattctgccacgtttaggatttgctgtatctttactgttaggccttgcagaacaggagaaatcaaagcaaattaaaattgctgccttaaaatgtttacaggttctactcttgcagtgtgattgtcaggaccatccaaggtcattggatgaacttgaacaaaagcagctgggggatttgtttgcctcttttttacctggaatctcaactgcactgaccaggcttatcacaggagactttaaacaaggtcacagcattgtcgtatcttccctaaagatcttttacaagacagtgagcttcattatggctgatgaacagctcaaaagaatctcaaaggtccaagcaaaacctgcagttgagcacagagtagcagagctgatggtttacagggaagcagattgggtaaaaaagactggcgacaagttgactatccttattaaaaagataattgagtgtgtttctgttcacccacactggaaggtgagactggaactggtagaacttgtggaggaccttcttttgaagtgcagtcaatcattggtcgaatgtgctggtccccttctgaaggccttagtgggactagtaaatgatgagagtcctgaaatccaagcccagtgcaataaagttctgagacattttgcagatcaaaaagtagtggtgggcaacaaagccctcgctgacatcttgtcagaaagcctgcattcccttgccacatctcttcctcgcctaatgaactcccaagatgaccagggcaaattctctactctttccttgttacttggttatctgaaactcttgggcccaaaaataaactttgtcctcaactctgtggcccatctccagcggctttccaaagcactcatccaagttctagagctagacgtggctgacatcaagattgttgaggaacggcgttggaactctgatgatctgaatgcttctccaaagacctcagccacacagccttggaaccgcatccagaggagatatttccgcttcttcactgatgagagaatcttcatgctcttgaggcaggtttgtcagctacttggttattatgggaatctttatttgcttgtggatcactttatggaactttaccatcaatctgtggtttaccggaagcaagctgccatgatccttaatgaactggttacaggggctgctgggctggaggttgaggatcttcacgaaaaacatattaaaacaaacccagaagaactgagagagattgtgacatctatacttgaagaatacacaagtcaagaaaattggtatttggttacctgtcttgaaactgaggaaatgggagaggagctgatgatggagcacccaggcctccaagccatcacgtctggtgaacacacctgccaagttacatcttttctagccttctcaaagccaagtcccactatttgctccatgaacagtaacatctggcaaatatgcattcagttggaaggaattggccagtttgcatatgcactaggaaaagacttctgtttgctcttgatgtcagccctttatccagtactggagaaggctggagaccaaaccctactcattagtcaggtggctaccagcaccatgatggacgtttgccgtgcttgtggctacgactccctgcagcacctgatcaatcaaaattcagactatttagtgaatgggatctctttaaatctgcgtcatctggctctgcatcctcataccccaaaggtcctggaagtcatgctgcggaactcagatgctaacctgcttcctttggtggcagatgtggttcaagatgtcttggccaccctggaccaattttacgataagagagctgcttcctttgtcagcgttctgcatgctctgatggcagcattagcccagtggttcccagacacaggtaatcttgggcacctccaagagcaaagtttaggagaagagggaagtcatttgaaccaaagaccagcagctcttgagaagagcaccaccacagctgaagacatcgaacagtttttgctgaactacctcaaagagaaggatgtggcagatggaaatgtctcggattttgataatgaagaagaggaacagtcagtccctcccaaagtggatgagaatgacacccgtccagatgtggagccaccactgccattgcagatccaaatagccatggacgtgatggaacgctgcatccacttgttgtcagataaaaatctgcaaatccgcctgaaggtcttggatgtgctggatctgtgtgtggttgttcttcagtcccacaaaaaccagctgcttcccttggctcatcaggcctggccctcgctcgttcaccgactcacacgggacgcccccctggcagtgcttagagccttcaaggttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgagggtgacctgaataaagtggctgatgcctgcttgatttacctcagtgtcaaacagcccgtgaaattacaagaggctgccaggagcgtcttcctccacttgatgaaggtggacccagactccacctggttcctcctgaacgagctttactgccccgtgcagttcacacctccccaccccagcctccaccctgtgcagctgcacggggccagcgggcagcagaacccctacacgaccaacgtgctccagctgctcaaggagctgcagtgaccctgctcccccaccacagaggccaccgatccctcccctactgccagccagaagctgggctgaccccaccccggccataggcggtggcagcggcagcagagaaggtgaattagttagccaatcgatttataaattgatcgatcacacaactgcttagaaatggattgaaggaaagtagctgactattatttatgtttcataccttgtgttgtcaagtgacattgtctggtggctctaagggtttaaccccttagcctaccatctctatagccccagctccctcacaggccacacacacacacacacaagaggtcagttcccctccatctgcatacacctccctgtcttcaaataatgagatggaactaatttgttttacctaacctgatctttgggaaacaaacggaaataaagacacttcttggatgaaaagtatgatcaaaagctca

SEQ ID NO: 31251 - DNA, 3791 bp, Homo sapiens
cttgctttgaacttgacatttttactgaacagtttccttcctccagcctgcaggatgtttcctcaatgaggggaaggctgctgcacaatggcagtttttgatactcctgaggaggcctttggtgtcttacgtccagtctgtgttcagctcacaaagacccagacagtggagaatgtggagcatctgcagacacgactacaagctgtgagtgacagtgcccttcaggaacttcagcagtacatcctcttccctctgcgatttaccctgaagaccccaggtcccaaaagagagcgtttgatccaaagtgtggtggaatgcctcacatttgtcctttcttcaacatgtgtgaaagaacaggagcttctccaggaactcttttcagaactctctgcttgtctgtattcacccagctcccaaaaacctgcggctgtgtccgaggagttgaaattggctgtgatccagggacttagcacattaatgcactcagcttatggggacatcattctgactttttatgagccctccattctgccacgtttaggatttgctgtatctttactgttaggccttgcagaacaggagaaatcaaagcaaattaaaattgctgccttaaaatgtttacaggttctactcttgcagtgtgattgtcaggaccatccaaggtcattggatgaacttgaacaaaagcagctgggggatttgtttgcctcttttttacctggaatctcaactgcactgaccaggcttatcacaggagactttaaacaaggtcacagcattgtcgtatcttccctaaagatcttttacaagacagtgagcttcattatggctgatgaacagctcaaaagaatctcaaaggtccaagcaaaacctgcagttgagcacagagtagcagagctgatggtttacagggaagcagattgggtaaaaaagactggcgacaagttgactatccttattaaaaagataattgagtgtgtttctgttcacccacactggaaggtgagactggaactggtagaacttgtggaggaccttcttttgaagtgcagtcaatcattggtcgaatgtgctggtccccttctgaaggccttagtgggactagtaaatgatgagagtcctgaaatccaagcccagtgcaataaagttctgagacattttgcagatcaaaaagtagtggtgggcaacaaagccctcgctgacatcttgtcagaaagcctgcattcccttgccacatctcttcctcgcctaatgaactcccaagatgaccagggcaaattctctactctttccttgttacttggttatctgaaactcttgggcccaaaaataaactttgtcctcaactctgtggcccatctccagcggctttccaaagcactcatccaagttctagagctagacgtggctgacatcaagattgttgaggaacggcgttggaactctgatgatctgaatgcttctccaaagacctcagccacacagccttggaaccgcatccagaggagatatttccgcttcttcactgatgagagaatcttcatgctcttgaggcaggtttgtcagctacttggttattatgggaatctttatttgcttgtggatcactttatggaactttaccatcaatctgtggtttaccggaagcaagctgccatgatccttaatgaactggttacaggggctgctgggctggaggttgaggatcttcacgaaaaacatattaaaacaaacccagaagaactgagagagattgtgacatctatacttgaagaatacacaagtcaagaaaattggtatttggttacctgtcttgaaactgaggaaatgggagaggagctgatgatggagcacccaggcctccaagccatcacgtctggtgaacacacctgccaagttacatcttttctagccttctcaaagccaagtcccactatttgctccatgaacagtaacatctggcaaatatgcattcagttggaaggaattggccagtttgcatatgcactaggaaaagacttctgtttgctcttgatgtcagccctttatccagtactggagaaggctggagaccaaaccctactcattagtcaggtggctaccagcaccatgatggacgtttgccgtgcttgtggctacgactccctgcagcacctgatcaatcaaaattcagactatttagtgaatgggatctctttaaatctgcgtcatctggctctgcatcctcataccccaaaggtcctggaagtcatgctgcggaactcagatgctaacctgcttcctttggtggcagatgtggttcaagatgtcttggccaccctggaccaattttacgataagagagctgcttcctttgtcagcgttctgcatgctctgatggcagcattagcccagtggttcccagacacaggtaatcttgggcacctccaagagcaaagtttaggagaagagggaagtcatttgaaccaaagaccagcagctcttgagaagagcaccaccacagctgaagacatcgaacagtttttgctgaactacctcaaagagaaggatgtggcagatggaaatgtctcggattttgataatgaagaagaggaacagtcagtccctcccaaagtggatgagaatgacacccgtccagatgtggagccaccactgccattgcagatccaaatagccatggacgtgatggaacgctgcatccacttgttgtcagataaaaatctgcaaatccgcctgaaggtcttggatgtgctggatctgtgtgtggttgttcttcagtcccacaaaaaccagctgcttcccttggctcatcaggcctggccctcgctcgttcaccgactcacacgggacgcccccctggcagtgcttagagccttcaaggttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgagggtgacctgaataaagtggctgatgcctgcttgatttacctcagtgtcaaacagcccgtgaaattacaagaggctgccaggagcgtcttcctccacttgatgaaggtggacccagactccacctggttcctcctgaacgagctttactgccccgtgcagttcacacctccccaccccagcctccaccctgtgcagctgcacggggccagcgggcagcagaacccctacacgaccaacgtgctccagctgctcaaggagctgcagtgaccctgctcccccaccacagaggccaccgatccctcccctactgccagccagaagctgggctgaccccaccccggccataggcggtggcagcggcagcagagaaggtgaattagttagccaatcgatttataaattgatcgatcacacaactgcttagaaatggattgaaggaaagtagctgactattatttatgtttcataccttgtgttgtcaagtgacattgtctggtggctctaagggtttaaccccttagcctaccatctctatagccccagctccctcacaggccacacacacacacacacaagaggtcagttcccctccatctgcatacacctccctgtcttcaaataatgagatggaactaatttgttttacctaacctgatctttgggaaacaaacggaaataaagacacttcttggatgaaaagt

SEQ ID NO: 31252 - DNA, 2242 bp, Homo sapiens
agacaccggcgggcgcgagccgttgcaggtacctgggggtggttaagttggtgacatggctcagaagtttatttctttaaatttttaagttttttttctttttagtcttcagaaaggcaacagtagtcttttaacgtcactgttaaaagtgtaagactcttttactccctgagagtcccctttccctttcttgcgtcctttcctctttattcttttttttttttttttttttactgagacggagtctcactctgtcgcccaggctggagtgcagtggcgcgatctcggctcactgcaaactccgcctcccgggttcaccctttctctttattcttatcccggtcagactcgccccctcctccaagacatctctctgttttattttatttgattttagttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaatgtaaaagatgcagttcttaaagacctcggtgatctaatagaagccacagaatttgataggttatttgaggggactggtgcacggctccgcggaatgccggagacactggggcaggtagcaaaagccctggagaagtatgcagccccctccaaggaggaggaaggtggaggtgatgggcactccgaagcggccgagaaagcagcccaagttgggttactgtttcttaaactgttagggaaagttgagactgctaagaattccctggtcggccctgcatggcagacgggcctgcatcacttggcaggacccgtttatatttttgccatcacacacagcttggagcaaccatggaccactccgagatctcgggaagttgctagggaggtgctcacctcactgcttcaagttactgaatgcggttctgtggcaggattcctacatggagaaaatgaagatgagaaagggagactttcggtgatactagggcttctcaaacccgacttgtataaggaatcctggaagaataaccctgccatcaaacatgttttctcatggactctgcaacaggtcactcggccctggctgagccagcatctggaaagggtacttcccgcatcattggtcatttcagatgactatcagactgagaacaaaatcctgggtgtacactgtctccatcacattgtgcttaatgtgccagctgctgatttgctccagtataacagagcccaggtcctataccatgccatttccaaccacctgtacacaccagagcaccacctcattcaggctgtgctcctgtgtctgctggatttattccccatcctggagaaaaccctgcactggaaaggagatggagctcgacccaccacccattgtgatgaggtcctgcggctgatcctgacccacatggagccagagcaccgccttcttttacgcaggacctacgcaagaaacctgccggctttcgtgaacaggttggggatcctaactgtccggcacttaaagaggctggagagagtcatcattggttatctggaggtttatgatggacctgaggaggaagctagactgaagatattggaaaccctaaaacttctcatgcaacatacttggcccagagtttcctgcagacttgtggtcttactgaaggccctcttgaaactgatttgtgatgtagcaagggatccaaaccttacacctgagtctgttaagagcgccctgctacaggaggccacagactgcctgattctcctggaccgctgttctcaaggacgggtaaagggtctcctggccaaaattccccaaagctgtgaagacagaaaagtggtgaactatatcagaaaagtgcagcaggtttctgaaggcgcaccctacaatggaacttaagacttgtattactttcccaagaggaaaggattttcttcccatcccaatttgtatgaatggagttatttaagaaaaaaagatatttttacacgaaactttgtaagtgaaagctgctttttccttccttcctttccttttacctccataagaatagggaaagtagaacaagaaaaaattgaactccttccatttctaaataaagtttgggagaaaaaagga

SEQ ID NO: 31253 - DNA, 2363 bp, Homo sapiens
gttaaatcgatccttgaagttcaggtcagacgggtaatgtgcccacgtcgtaacaaggttcaagggtggcacatctcacacaagcgtatgaacacccaatcatcacgctcatgaactacaaaaggatcatcttatagttgacattaaggagtgccaagtatgtgccactaatttacacatagggtgactaccgtaatgcgatacatccattcttcacgtataaaatcctggatattttcaaagtcccactgagattctgtgattattcttttgtttctaccttagcaaaggaaaacagaaacacaattagcgagcggattattatatatgcaaatttattctctatagttccacctctccgtcattttcccgagcctggatctttattgctttacgaccatacgtcgtgaaataagaaggtgttgcggcagtactggcggaagctagccttgcgttttgcggcagcaatatgagctaggtccggatcctgttagacaccggcgggcgcgagccgttgcagttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaatgtaaaagatgcagttcttaaagacctcggtgatctaatagaagccacagaatttgataggttatttgaggggactggtgcacggctccgcggaatgccggagacactggggcaggtagcaaaagccctggagaagtatgcagccccctccaaggaggaggaaggtggaggtgatgggcactccgaagcggccgagaaagcagcccaagttgggttactgtttcttaaactgttagggaaagttgagactgctaagaattccctggtcggccctgcatggcagacgggcctgcatcacttggcaggacccgtttatatttttgccatcacacacagcttggagcaaccatggaccactccgagatctcgggaagttgctagggaggtgctcacctcactgcttcaagttactgaatgcggttctgtggcaggattcctacatggagaaaatgaagatgagaaagggagactttcggtgatactagggcttctcaaacccgacttgtataaggaatcctggaagaataaccctgccatcaaacatgttttctcatggactctgcaacaggtcactcggccctggctgagccagcatctggaaagggtacttcccgcatcattggtcatttcagatgactatcagactgagaacaaaatcctgggtgtacactgtctccatcacattgtgcttaatgtgccagctgctgatttgctccagtataacagagcccaggtcctataccatgccatttccaaccacctgtacacaccagagcaccacctcattcaggctgtgctcctgtgtctgctggatttattccccatcctggagaaaaccctgcactggaaaggagatggagctcgacccaccacccattgtgatgaggtcctgcggctgatcctgacccacatggagccagagcaccgccttcttttacgcaggacctacgcaagaaacctgccggctttcgtgaacaggttggggatcctaactgtccggcacttaaagaggctggagagagtcatcattggttatctggaggtttatgatggacctgaggaggaagctagactgaagatattggaaaccctaaaacttctcatgcaacatacttggcccagagtttcctgcagacttgtggtcttactgaaggccctcttgaaactgatttgtgatgtagcaagggatccaaaccttacacctgagtctgttaagagcgccctgctacaggaggccacagactgcctgattctcctggaccgctgttctcaaggacgggtaaagggtctcctggccaaaattccccaaagctgtgaagacagaaaagtggtgaactatatcagaaaagtgcagcaggtttctgaaggcgcaccctacaatggaacttaagacttgtattactttcccaagaggaaaggattttcttcccatcccaatttgtatgaatggagttatttaagaaaaaaagatatttttacacgaaactttgtaagtgaaagctgctttttccttccttcctttccttttacctccataagaatagggaaagtagaacaagaaaaaattgaactccttccatttctaaataaagtttgggagaaaaaag

SEQ ID NO: 31254 - DNA, 1828 bp, Homo sapiens
gggcgcgagccgttgcaggtacctgggggtggttaagttggtgacatggctcagaagtttatttctttaaatttttaagttttttttctttttagtcttcagaaaggcaacagtagtcttttaacgtcactgttaaaagtttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaatgtaaaagatgcagttcttaaagacctcggtgatctaatagaagccacagaatttgataggttatttgaggggactggtgcacggctccgcggaatgccggagacactggggcaggtagcaaaagccctggagaagtatgcagccccctccaaggaggaggaaggtggaggtgatgggcactccgaagcggccgagaaagcagcccaagttgggttactgtttcttaaactgttagggaaagttgagactgctaagaattccctggtcggccctgcatggcagacgggcctgcatcacttggcaggacccgtttatatttttgccatcacacacagcttggagcaaccatggaccactccgagatctcgggaagttgctagggaggtgctcacctcactgcttcaagttactgaatgcggttctgtggcaggattcctacatggagaaaatgaagatgagaaagggagactttcggtgatactagggcttctcaaacccgacttgtataaggaatcctggaagaataaccctgccatcaaacatgttttctcatggactctgcaacaggtcactcggccctggctgagccagcatctggaaagggtacttcccgcatcattggtcatttcagatgactatcagactgagaacaaaatcctgggtgtacactgtctccatcacattgtgcttaatgtgccagctgctgatttgctccagtataacagagcccaggtcctataccatgccatttccaaccacctgtacacaccagagcaccacctcattcaggctgtgctcctgtgtctgctggatttattccccatcctggagaaaaccctgcactggaaaggagatggagctcgacccaccacccattgtgatgaggtcctgcggctgatcctgacccacatggagccagagcaccgccttcttttacgcaggacctacgcaagaaacctgccggctttcgtgaacaggctggagagagtcatcattggttatctggaggtttatgatggacctgaggaggaagctagactgaagatattggaaaccctaaaacttctcatgcaacatacttggcccagagtttcctgcagacttgtggtcttactgaaggccctcttgaaactgatttgtgatgtagcaagggatccaaaccttacacctgagtctgttaagagcgccctgctacaggaggccacagactgcctgattctcctggaccgctgttctcaaggacgggtaaagggtctcctggccaaaattccccaaagctgtgaagacagaaaagtggtgaactatatcagaaaagtgcagcaggtttctgaaggcgcaccctacaatggaacttaagacttgtattactttcccaagaggaaaggattttcttcccatcccaatttgtatgaatggagttatttaagaaaaaaagatatttttacacgaaa

SEQ ID NO: 31255 - DNA, 485 bp, Homo sapiens
ggatcctgttagacaccggcgggcgcgagccgttgcagtcttcagaaaggcaacagtagtcttttaacgtcactgttaaaagtttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaatgtaaaagatgcagttcttaaagacctcggtgatctaatagaagccacagaatttgataggttatttgaggggactggtgcacggctccgcggaatgccggagacactggggcaggtagcaaaagccctggagaagtatgcagccccctccaaggaggaggaaggt

SEQ ID NO: 31256 - DNA, 3829 bp, Homo sapiens
caggcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttg

SEQ ID NO: 31257 - DNA, 4018 bp, Homo sapiens
caggcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaa

SEQ ID NO: 31258 - DNA, 3210 bp, Homo sapiens
atgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactga

SEQ ID NO: 31259 - DNA, 2486 bp, Homo sapiens
atgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggtgaggcccgtgcc

SEQ ID NO: 31260 - DNA, 994 bp, Homo sapiens
gccccttctttctccgtggccctttggcgcgtgagtgacagcggcccagacagagggggcgatgtccgcgtcgtggctggggccggtcgcggggcagactaatcccctgctcctggccaggggaggctcccgagcggatcctcgggaaaggggctccgaaggtcaagaaactgccctgctgggcgtccggggagtgggaaaataaagcactttttgtatcccgcccctcccccgtcacgtgaccacgcgaggcggaaagaagaaatccgaggaccggcgacgcctagaacaggagcccatgatgctgcccaaacctgggacctattacctcccctgggaggttagtgcaggccaagttcctgatgggagcacgctgagaacatttggcaggttgtgcctctatgacatgattcagtccagagtaacactgatggctcagcacggatccgatcagcaccaggttcttgtctgtaccaagttggtggagcccttccacgcccaggtgggctccctgtacatcgtcctcggggagctccagcatcagcaggacagaggctccgtggtgaaggcgcgcgtgctgacctgtgtggaggggatgaacctgcccttgttggaacaagccatccgggagcagagactgtacaagcaggagcggggcggcagccagtaggaaacagcagcctagcaacaccctcacctgcttcagagcccgaaccctctggagctgcaggagcccgggagagcacagacgcctccccagcgacggccttgtctggagctcgaaagccgaggggcgggtgatgaatccagccccttcccctactttgggattggctcagcaatgagaacccagaaagcatgccataaatccgacagccccaccccaggagactgcaggtggccgagcttgggcgccggggccgtgcttggtgtggggccatggagggttccagaaggtcctggtgaataaaggcccagggggcgtgctcttgaa

SEQ ID NO: 31261 - DNA, 992 bp, Homo sapiens
gccccttctttctccgtggccctttggcgcgtgagtgacagcggcccagacagagggggcgatgtccgcgtcgtggctggggccggtcgcggggcagactaatcccctgctcctggccaggggaggctcccgagcggatcctcgggaaaggggctccgaaggtcaagaaactgccctgctgggcgtccggggagtgggaaaataaagcactttttgtatcccgcccctcccccgtcacgtgaccacgcgaggcggaaagaagaaatccgaggaccggcgacgcctagaacaggagcccatgatgctgcccaaacctgggacctattacctcccctgggaggttagtgcaggccaagttcctgatgggagcacgctgagaacatttggcaggttgtgcctctatgacatgattcagtccagagtaacactgatggctcagcacggatccgatcagcaccaggttcttgtctgtaccaagttggtggagcccttccacgcccaggtgggctccctgtacatcgtcctcggggagctccagcatcagcaggacagaggctccgtggtgaaggcgcgcgtgctgacctgtgtggaggggatgaacctgcccttgttggaacaagccatccgggagcagagactgtacaagcaggagcggggcggcagccagtaggaaacagcagcctagcaacaccctcacctgcttcagagcccgaaccctctggagctgcaggagcccgggagagcacagacgcctccccagcgacggccttgtctggagctcgaaagccgaggggcgggtgatgaatccagccccttcccctactttgggattggctcagcaatgagaacccagaaagcatgccataaatccgacagccccaccccaggagactgcaggtggccgagcttgggcgccggggccgtgcttggtgtggggccatggagggttccagaaggtcctggtgaataaaggcccagggggcgtgctcttg

SEQ ID NO: 31262 - DNA, 6506 bp, Homo sapiens
attacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgtt

SEQ ID NO: 31263 - DNA, 5687 bp, Homo sapiens
attacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgtt

SEQ ID NO: 31264 - DNA, 5960 bp, Homo sapiens
attacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgtt

SEQ ID NO: 31265 - DNA, 7641 bp, Homo sapiens
aattcgccaactgaaaaagtgggaaaggatgtctggaggcgaggcgtcccattacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 31266 - DNA, 3602 bp, Homo sapiens
attacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccaccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaa

SEQ ID NO: 31267 - DNA, 734 bp, Homo sapiens
ggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagatttctatagacacctagctgtgctttcttacaagaaaacatatccactggaccaaagcgcagcccccttcatgctgaagccacttcagtttgaaacgtaaaaaaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtg

SEQ ID NO: 31268 - DNA, 6233 bp, Homo sapiens
attacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgtt

SEQ ID NO: 31269 - DNA, 5517 bp, Homo sapiens
atgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaaccaaagccacagttgggcacgctaatctttagcaatattactccaaaaagcttcaacatgtcatggaccactcaagctgggctttttgcaaagattgttatcaatgtgagtgacgctcactcactgcatgagtcccagcaattcacagtctcaggagatgcaaagcaagctcacatcacaggcttggtggagaacactggctatgacgtcagtgtggcaggaaccaccttggctggggatcccaccagacccctcactgcctttgtcattacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataa

SEQ ID NO: 31270 - DNA, 5190 bp, Homo sapiens
ccaggcttcctcctctctttcacgtcagaggcaggaaccgactgtgctaaggctgttggctcaacacccagaggagacgggcagacccagggagagtgagagaagggggtcctctctgacccaaggaattaccactagtggagtgaagccacctgactttttgatcttattttggttgcctcctcattctccttccacccgtagccctgacagcttgggtttcatttctttcgtggagccttgtctcttcctcccagaataggaggaagggaagagaagggaaagaggagggctctctaggtgagcgcatcagctggctccagcctgagcaagcaagaattttcttcccaggaagctcctctcgctccccggccgcccacccccagcctgggtggctgtatcgttttaactgcatagagggcaggtctcttttggaattaggattaaagaaagtgcagtaaagagaaagcatcgaagacaccatcacaaaagattcccacaactccatgctgtgtgctgcaggctggtcctgaacccagatctctggctgagaggatgggggcagatggggaaacagtggttctgaagaacatgctcattggcatcaacctgatccttctgggctccatgatcaagccttcagagtgtcagctggaggtcaccacagaaagggtccagagacagtcagtggaggaggagggaggcattgccaactacaacacatccagcaaagagcagcctgtggtcttcaaccacgtgtacaacattaacgtgcccttggacaacctctgctcctcagggctagaggcctctgctgagcaggaggtgagtgcagaagacgagactctggcagagtacatgggccagacctcagaccacgagagccaggtcacctttacacacaggatcaacttccccaaaaaggcctgtccatgtgccagttcagcccaggtgctgcaggagctgctgagccggatcgagatgctggagagggaggtgtcggtgctgcgagaccagtgcaacgccaactgctgccaagaaagtgctgccacaggacaactggactatatccctcactgcagtggccacggcaactttagctttgagtcctgtggctgcatctgcaacgaaggctggtttggcaagaattgctcggagccctactgcccgctgggttgctccagccggggggtgtgtgtggatggccagtgcatctgtgacagcgagtacagcggggatgactgttccgaactccggtgcccaacagactgcagctcccgggggctctgcgtggacggggagtgtgtctgtgaagagccctacactggcgaggactgcagggaactgaggtgccctggggactgttcggggaaggggagatgtgccaacggtacctgtttatgcgaggagggctacgttggtgaggactgcggccagcggcagtgtctgaatgcctgcagtgggcgaggacaatgtgaggaggggctctgcgtctgtgaagagggctaccagggccctgactgctcagcagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccatctctccactcctcaagggctacaatttaagacgatcacagagaccaccgtggaggtgcagtgggagcccttctcattttccttcgatgggtgggaaatcagcttcattccaaagaacaatgaagggggagtgattgctcaggtccccagcgatgttacgtcctttaaccagacaggactaaagcctggggaggaatacattgtcaatgtggtggctctgaaagaacaggcccgcagcccccctacctcggccagcgtctccacagtcattgacggccccacgcagatcctggttcgcgatgtctcggacactgtggcttttgtggagtggattccccctcgagccaaagtcgatttcattcttttgaaatatggcctggtgggcggggaaggtgggaggaccaccttccggctgcagcctcccctgagccaatactcagtgcaggccctgcggcctggctcccgatacgaggtgtcagtcagtgccgtccgagggaccaacgagagcgattctgccaccactcagttcacaacagagatcgatgcccccaagaacttgcgagttggttctcgcacagcaaccagccttgacctcgagtgggataacagtgaagccgaagttcaggagtacaaggttgtgtacagcaccctggcgggtgagcaatatcatgaggtactggtccccaggggcattggtccaaccaccagggccaccctgacagatctggtacctggcactgagtatggagttggaatatctgccgtcatgaactcacagcaaagcgtgccagccaccatgaatgccaggactgaacttgacagtccccgagacctcatggtgacagcctcctcggagacctccatctccctcatctggaccaaggccagtggccccattgaccactaccgaattacctttaccccatcctctgggattgcctcagaagtcaccgtacccaaggacaggacctcatacacactaacagatctagagcctggggcagagtacatcatttccgtcactgctgagaggggtcggcagcagagcttggagtccactgtggatgctttcacaggcttccgtcccatctctcatctgcacttttctcatgtgacctcctccagtgtgaacatcacttggagtgatccatctcccccagcagacagactcattcttaactacagccccagggatgaggaggaagagatgatggaggtctccctggatgccaccaagaggcatgctgtcctgatgggcctgcaaccagccacagagtatattgtgaaccttgtggctgtccatggcacagtgacctctgagcccattgtgggctccatcaccacaggaattgatcccccaaaagacatcacaattagcaatgtgaccaaggactcagtgatggtctcctggagccctcctgttgcatctttcgattactaccgagtatcatatcgacccacccaagtgggacgactagacagctcagtggtgcccaacactgtgacagaattcaccatcaccagactgaacccagctaccgaatacgaaatcagcctcaacagcgtgcggggcagggaggaaagcgagcgcatctgtactcttgtgcacacagccatggacaaccctgtggatctgattgctaccaatatcactccaacagaagccctgctgcagtggaaggcaccagtgggtgaggtggagaactacgtcattgttcttacacactttgcagtcgctggagagaccatccttgttgacggagtcagtgaggaatttcggcttgttgacctgcttcctagcacccactatactgccaccatgtatgccaccaatggacctctcaccagtggcaccatcagcaccaacttttctactctcctggaccctccggcaaacctgacagccagtgaagtcaccagacaaagtgccctgatctcctggcagcctcccagggcagagattgaaaattatgtcttgacctacaaatccaccgatggaagccgcaaggagctgattgtggatgcagaagacacctggattcgactggagggcctgttggagaacacagactacacggtgctcctgcaggcagcacaggacaccacgtggagcagcatcacctccaccgctttcaccacaggaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtattccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccaagaggccgccttcgcctcctacgacaggttctctgtcgaggacagcagaaacctgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacaccgcatcccaacaacccaggttcttttccttccttccttccttcctcccttccttctttcctgccttccc

SEQ ID NO: 31271 - DNA, 4920 bp, Homo sapiens
ccaggcttcctcctctctttcacgtcagaggcaggaaccgactgtgctaaggctgttggctcaacacccagaggagacgggcagacccagggagagtgagagaagggggtcctctctgacccaaggaattaccactagtggagtgaagccacctgactttttgatcttattttggttgcctcctcattctccttccacccgtagccctgacagcttgggtttcatttctttcgtggagccttgtctcttcctcccagaataggaggaagggaagagaagggaaagaggagggctctctaggtgagcgcatcagctggctccagcctgagcaagcaagaattttcttcccaggaagctcctctcgctccccggccgcccacccccagcctgggtggctgtatcgttttaactgcatagagggcaggtctcttttggaattaggattaaagaaagtgcagtaaagagaaagcatcgaagacaccatcacaaaagattcccacaactccatgctgtgtgctgcaggctggtcctgaacccagatctctggctgagaggatgggggcagatggggaaacagtggttctgaagaacatgctcattggcatcaacctgatccttctgggctccatgatcaagccttcagagtgtcagctggaggtcaccacagaaagggtccagagacagtcagtggaggaggagggaggcattgccaactacaacacatccagcaaagagcagcctgtggtcttcaaccacgtgtacaacattaacgtgcccttggacaacctctgctcctcagggctagaggcctctgctgagcaggaggtgagtgcagaagacgagactctggcagagtacatgggccagacctcagaccacgagagccaggtcacctttacacacaggatcaacttccccaaaaaggcctgtccatgtgccagttcagcccaggtgctgcaggagctgctgagccggatcgagatgctggagagggaggtgtcggtgctgcgagaccagtgcaacgccaactgctgccaagaaagtgctgccacaggacaactggactatatccctcactgcagtggccacggcaactttagctttgagtcctgtggctgcatctgcaacgaaggctggtttggcaagaattgctcggagccctactgcccgctgggttgctccagccggggggtgtgtgtggatggccagtgcatctgtgacagcgagtacagcggggatgactgttccgaactccggtgcccaacagactgcagctcccgggggctctgcgtggacggggagtgtgtctgtgaagagccctacactggcgaggactgcagggaactgaggtgccctggggactgttcggggaaggggagatgtgccaacggtacctgtttatgcgaggagggctacgttggtgaggactgcggccagcggcagtgtctgaatgcctgcagtgggcgaggacaatgtgaggaggggctctgcgtctgtgaagagggctaccagggccctgactgctcagcagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccatctctccactcctcaagggctacaatttaagacgatcacagagaccaccgtggaggtgcagtgggagcccttctcattttccttcgatgggtgggaaatcagcttcattccaaagaacaatgaagggggagtgattgctcaggtccccagcgatgttacgtcctttaaccagacaggactaaagcctggggaggaatacattgtcaatgtggtggctctgaaagaacaggcccgcagcccccctacctcggccagcgtctccacagtcattgacggccccacgcagatcctggttcgcgatgtctcggacactgtggcttttgtggagtggattccccctcgagccaaagtcgatttcattcttttgaaatatggcctggtgggcggggaaggtgggaggaccaccttccggctgcagcctcccctgagccaatactcagtgcaggccctgcggcctggctcccgatacgaggtgtcagtcagtgccgtccgagggaccaacgagagcgattctgccaccactcagttcacaacagagatcgatgcccccaagaacttgcgagttggttctcgcacagcaaccagccttgacctcgagtgggataacagtgaagccgaagttcaggagtacaaggttgtgtacagcaccctggcgggtgagcaatatcatgaggtactggtccccaggggcattggtccaaccaccagggccaccctgacagatctggtacctggcactgagtatggagttggaatatctgccgtcatgaactcacagcaaagcgtgccagccaccatgaatgccaggactgaacttgacagtccccgagacctcatggtgacagcctcctcggagacctccatctccctcatctggaccaaggccagtggccccattgaccactaccgaattacctttaccccatcctctgggattgcctcagaagtcaccgtacccaaggacaggacctcatacacactaacagatctagagcctggggcagagtacatcatttccgtcactgctgagaggggtcggcagcagagcttggagtccactgtggatgctttcacaggaattgatcccccaaaagacatcacaattagcaatgtgaccaaggactcagtgatggtctcctggagccctcctgttgcatctttcgattactaccgagtatcatatcgacccacccaagtgggacgactagacagctcagtggtgcccaacactgtgacagaattcaccatcaccagactgaacccagctaccgaatacgaaatcagcctcaacagcgtgcggggcagggaggaaagcgagcgcatctgtactcttgtgcacacagccatggacaaccctgtggatctgattgctaccaatatcactccaacagaagccctgctgcagtggaaggcaccagtgggtgaggtggagaactacgtcattgttcttacacactttgcagtcgctggagagaccatccttgttgacggagtcagtgaggaatttcggcttgttgacctgcttcctagcacccactatactgccaccatgtatgccaccaatggacctctcaccagtggcaccatcagcaccaacttttctactctcctggaccctccggcaaacctgacagccagtgaagtcaccagacaaagtgccctgatctcctggcagcctcccagggcagagattgaaaattatgtcttgacctacaaatccaccgatggaagccgcaaggagctgattgtggatgcagaagacacctggattcgactggagggcctgttggagaacacagactacacggtgctcctgcaggcagcacaggacaccacgtggagcagcatcacctccaccgctttcaccacaggaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtattccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccaagaggccgccttcgcctcctacgacaggttctctgtcgaggacagcagaaacctgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacaccgcatcccaacaacccaggttcttttccttccttccttccttcctcccttccttctttcctgccttccc

SEQ ID NO: 31272 - DNA, 5344 bp, Homo sapiens
cactagggggctgcttgtagggggatggaaaaaacggaggcttaaaaaaatcatgctgctgaaatttcagcaagaggggaaaagagagagcgcgtgagagagagagagagagagagagagagagagagagagagagagagacagcaaagcagtcccaggcttcctcctctctttcacgtcagaggcaggaaccgactgtgctaaggctgttggctcaacacccagaggagacgggcagacccagggagagtgagagaagggggtcctctctgacccaaggaattaccactagtggagtgaagccacctgactttttgatcttattttggttgcctcctcattctccttccacccgtagccctgacagcttgggtttcatttctttcgtggagccttgtctcttcctcccagaataggaggaagggaagagaagggaaagaggagggctctctaggtgagcgcatcagctggctccagcctgagcaagcaagaattttcttcccaggaagctcctctcgctccccggccgcccacccccagcctgggtggctgtatcgttttaactgcatagagggcaggtctcttttggaattaggattaaagaaagtgcagtaaagagaaagcatcgaagacaccatcacaaaagattcccacaactccatgctgtgtgctgcaggctggtcctgaacccagatctctggctgagaggatgggggcagatggggaaacagtggttctgaagaacatgctcattggcatcaacctgatccttctgggctccatgatcaagccttcagagtgtcagctggaggtcaccacagaaagggtccagagacagtcagtggaggaggagggaggcattgccaactacaacacatccagcaaagagcagcctgtggtcttcaaccacgtgtacaacattaacgtgcccttggacaacctctgctcctcagggctagaggcctctgctgagcaggaggtgagtgcagaagacgagactctggcagagtacatgggccagacctcagaccacgagagccaggtcacctttacacacaggatcaacttccccaaaaaggcctgtccatgtgccagttcagcccaggtgctgcaggagctgctgagccggatcgagatgctggagagggaggtgtcggtgctgcgagaccagtgcaacgccaactgctgccaagaaagtgctgccacaggacaactggactatatccctcactgcagtggccacggcaactttagctttgagtcctgtggctgcatctgcaacgaaggctggtttggcaagaattgctcggagccctactgcccgctgggttgctccagccggggggtgtgtgtggatggccagtgcatctgtgacagcgagtacagcggggatgactgttccgaactccggtgcccaacagactgcagctcccgggggctctgcgtggacggggagtgtgtctgtgaagagccctacactggcgaggactgcagggaactgaggtgccctggggactgttcggggaaggggagatgtgccaacggtacctgtttatgcgaggagggctacgttggtgaggactgcggccagcggcagtgtctgaatgcctgcagtgggcgaggacaatgtgaggaggggctctgcgtctgtgaagagggctaccagggccctgactgctcagcagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccatctctccactcctcaagggctacaatttaagacgatcacagagaccaccgtggaggtgcagtgggagcccttctcattttccttcgatgggtgggaaatcagcttcattccaaagaacaatgaagggggagtgattgctcaggtccccagcgatgttacgtcctttaaccagacaggactaaagcctggggaggaatacattgtcaatgtggtggctctgaaagaacaggcccgcagcccccctacctcggccagcgtctccacagtcattgacggccccacgcagatcctggttcgcgatgtctcggacactgtggcttttgtggagtggattccccctcgagccaaagtcgatttcattcttttgaaatatggcctggtgggcggggaaggtgggaggaccaccttccggctgcagcctcccctgagccaatactcagtgcaggccctgcggcctggctcccgatacgaggtgtcagtcagtgccgtccgagggaccaacgagagcgattctgccaccactcagttcacaacagagatcgatgcccccaagaacttgcgagttggttctcgcacagcaaccagccttgacctcgagtgggataacagtgaagccgaagttcaggagtacaaggttgtgtacagcaccctggcgggtgagcaatatcatgaggtactggtccccaggggcattggtccaaccaccagggccaccctgacagatctggtacctggcactgagtatggagttggaatatctgccgtcatgaactcacagcaaagcgtgccagccaccatgaatgccaggactgaacttgacagtccccgagacctcatggtgacagcctcctcggagacctccatctccctcatctggaccaaggccagtggccccattgaccactaccgaattacctttaccccatcctctgggattgcctcagaagtcaccgtacccaaggacaggacctcatacacactaacagatctagagcctggggcagagtacatcatttccgtcactgctgagaggggtcggcagcagagcttggagtccactgtggatgctttcacaggcttccgtcccatctctcatctgcacttttctcatgtgacctcctccagtgtgaacatcacttggagtgatccatctcccccagcagacagactcattcttaactacagccccagggatgaggaggaagagatgatggaggtctccctggatgccaccaagaggcatgctgtcctgatgggcctgcaaccagccacagagtatattgtgaaccttgtggctgtccatggcacagtgacctctgagcccattgtgggctccatcaccacaggaattgatcccccaaaagacatcacaattagcaatgtgaccaaggactcagtgatggtctcctggagccctcctgttgcatctttcgattactaccgagtatcatatcgacccacccaagtgggacgactagacagctcagtggtgcccaacactgtgacagaattcaccatcaccagactgaacccagctaccgaatacgaaatcagcctcaacagcgtgcggggcagggaggaaagcgagcgcatctgtactcttgtgcacacagccatggacaaccctgtggatctgattgctaccaatatcactccaacagaagccctgctgcagtggaaggcaccagtgggtgaggtggagaactacgtcattgttcttacacactttgcagtcgctggagagaccatccttgttgacggagtcagtgaggaatttcggcttgttgacctgcttcctagcacccactatactgccaccatgtatgccaccaatggacctctcaccagtggcaccatcagcaccaacttttctactctcctggaccctccggcaaacctgacagccagtgaagtcaccagacaaagtgccctgatctcctggcagcctcccagggcagagattgaaaattatgtcttgacctacaaatccaccgatggaagccgcaaggagctgattgtggatgcagaagacacctggattcgactggagggcctgttggagaacacagactacacggtgctcctgcaggcagcacaggacaccacgtggagcagcatcacctccaccgctttcaccacaggaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtattccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccaagaggccgccttcgcctcctacgacaggttctctgtcgaggacagcagaaacctgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacaccgcatcccaacaacccaggttcttttccttccttccttccttcctcccttccttctttcctgccttccc

SEQ ID NO: 31273 - DNA, 529 bp, Homo sapiens
gatcaacttccccaaaaaggcctgtccatgtgccagttcagcccaggtgctgcaggagctgctgagccggatcgagatgctggagagggaggtgtcggtgctgcgagaccagtgcaacgccaactgctgccaagaaagtgctgccacagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccatctctccactcctcaagggctacaatttaagacgatcacagagaccaccgtggaggtgcagtgggagcccttctcattttccttcgatgggtgggaaatcagcttcattccaaag

SEQ ID NO: 31274 - DNA, 13065 bp, Homo sapiens
tcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacgctggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccacctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccactcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgtgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctaggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacaggagcaataaaggagaaactgaggtacccgg

SEQ ID NO: 31275 - DNA, 6643 bp, Homo sapiens
ctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggatgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctgacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgcgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcactggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcacactggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtagacacctatgacatccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagacccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgatcgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgg

SEQ ID NO: 31276 - DNA, 31 bp, Homo sapiens
cctcctgaatgatgccagcccagtatgctct

SEQ ID NO: 31277 - DNA, 320 bp, Homo sapiens
cttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaaggcctcctgaatgatgccagcccagtatgctct

SEQ ID NO: 31278 - DNA, 10084 bp, Homo sapiens
ggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccacctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccaggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtatggcctccacgaggggcggcgcgtgggcccggtgtccaccgtgggcgtgactgccccacaagaggatgtggacgagacccccagccctacagaaccaggcacagaggccccagggccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcagggtcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacaggagcaataaaggagaaactgaggtacccgg

SEQ ID NO: 31279 - DNA, 13065 bp, Homo sapiens
tcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggatgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctgacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgcgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcacactggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtagacacctatgacatccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagacccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgatcgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgg

SEQ ID NO: 31280 - DNA, 372 bp, Homo sapiens
agttcaggtttatgtgtgtgcatttcttttttattattattaaataaacaacttggagggagttgaaggaatggtggctgccttcctggctcgtgatggggagtttgggggaaagtggcttttccagagccagcatcaaagaatcaagcactgaagacatagctggctctgaggtggggtgggtgcgggatcacagaccgcatgtcatccccttgcccccacccctgcaactctggggtatatctgtgtctagcaacgatgtctcatggcgtgacagactagaggatacgcatccctggaatgtgagtcaacaggaaagatggggccccacgcccttcaggcctcctgaatgatgccagcccagtatgctct

SEQ ID NO: 31281 - DNA, 1902 bp, Homo sapiens
ggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacgg

SEQ ID NO: 31282 - DNA, 372 bp, Homo sapiens; identical to SEQ ID NO: 31280

SEQ ID NO: 31283 - DNA, 13065 bp, Homo sapiens
tcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccaccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggatgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctgacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgcgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggatgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccatcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtagacacctatgacatccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagacccaggagatcctgctcccaggagggatcacatctcaccagctccttggcctctttccctccacctcctacaatgcacggctccaggccacgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgg

SEQ ID NO: 31284 - DNA, 372 bp, Homo sapiens; identical to SEQ ID NO: 31280

SEQ ID NO: 31285 - DNA, 6849 bp, Homo sapiens
cctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccacctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactg

SEQ ID NO: 31286 - DNA, 2852 bp, Homo sapiens
agctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcacactggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtagacacctatgacatccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagacccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgatcgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccggc

SEQ ID NO: 31287 - DNA, 651 bp, Homo sapiens
gccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtatggcctccacgaggggcggcgcgtgggcccggtgtccaccgtgggcgtgact

SEQ ID NO: 31288 - DNA, 13125 bp, Homo sapiens
tcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggatgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctgacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgcgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagaggatgaagcagagaccacccaagcagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcacactggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtagacacctatgacatccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagacccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgatcgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgg

SEQ ID NO: 31289 - DNA, 13125 bp, Homo sapiens
tcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacgctggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccacctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccactcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgtgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctaggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagaggatgaagcagagaccacccaagcagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacaggagcaataaaggagaaactgaggtacccgg

SEQ ID NO: 31290 - DNA, 2597 bp, Homo sapiens
ctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccaggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaa

SEQ ID NO: 31291 - DNA, 13125 bp, Homo sapiens
tcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccaccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggatgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctgacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgcgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggatgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagaggatgaagcagagaccacccaagcagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccatcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtagacacctatgacatccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagacccaggagatcctgctcccaggagggatcacatctcaccagctccttggcctctttccctccacctcctacaatgcacggctccaggccacgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgg

SEQ ID NO: 31292 - DNA, 2852 bp, Homo sapiens
agctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacaggagcaataaaggagaaactgaggtacccggc

SEQ ID NO: 31293 - DNA, 651 bp, Homo sapiens
gccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctgacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgcgtgggcccggtgtccaccgtgggcgtgact

SEQ ID NO: 31294 - DNA, 939 bp, Homo sapiens
acagaaccaggcacagaggccccagggccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgaca

SEQ ID NO: 31295 - DNA, 939 bp, Homo sapiens
atgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcactggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagctccagaggatgaagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgaca

SEQ ID NO: 31296 - DNA, 1281 bp, Homo sapiens
atgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccacctgggaaacctgtggg

SEQ ID NO: 31297 - DNA, 2597 bp, Homo sapiens
ctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaa

SEQ ID NO: 31298 - DNA, 10331 bp, Homo sapiens
gttggcccgccccctgggctggcctgggagggaacccgactagcagagccctctgctcagttgctcccagcagtggccctgggaccagctctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagaggaagatgaggggaaggtggtggtcaggctgtcagaagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcacctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaaagaaaactctg

SEQ ID NO: 31299 - DNA, 1792 bp, Homo sapiens
gagccacccagtagtgtctgagtggtgatccactcttgcctgcaatgaggaccaaggcaaaaagagttggctgaatctgcagcaggaaggatgagggttagataccaggaggaaattcctgacagtgagaaaagtaagacactctgtctgggaggctgtcgaatttcctttcatggtgccctttcagcaaaggaaggattgtgttttggagggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggatgggaacaaacagaataccaatagccagtcaattggaagcatctcaggtggcctggaggatcaatatacctggccagacacacactggccttcccaaagttaggccctccaaaatgtcaagttgccaagccagaatccaaagctttgcactgagaacttcatgttggggctcctgtcccctcctggagccctgcctgggtgacaccccagtccttctattcaggtcctgtgttcacctctgggaagtgcaggaccctgtggggttttttctttttccttttccaagccaaggaagtgttctggctcctggactctgccctgtggaggggaaagggggagagagagggaaaaaaagatttccaccttattgttcagcagctggaaaattgttgtcatctgttctgccttccatttgctgagaatggaaaaaaaatgtggaaaatttggggaaataaatctcaataccctcata

SEQ ID NO: 31300 - DNA, 667 bp, Homo sapiens
cttccctccgtccctccttccctccttccttcccgagcgcggattgcgggctggggtgggaggagatttcgcggagtttccatttcatacctcgcggctaaaactttctttctgtgtctcgccctcttgcagtctgcagcttctcctgtcatcggaaatgccaggccaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgc

SEQ ID NO: 31301 - DNA, 5900 bp, Homo sapiens
aaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcaccc

SEQ ID NO: 31302 - DNA, 538 bp, Homo sapiens
agtagccccacttggctcttccctccttcactgctgaggagctgctcattggtccgaggcagctgggactctgggcagagccttcttccggacagctggatggagggtccccctcttagcagagctgctctaacttggggctcagctgggagctggacctcggaacccacctatcctgcctcgtaggcactgcggagccaggagaggggtgcaggggctcctcttcttggagaccccgtggtcaagccccaggttggagtgtgaatcctgcctggccgtcaacttcccagggacttgaggggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctg

SEQ ID NO: 31303 - DNA, 582 bp, Homo sapiens
agttgctcccagcagtggccctgggaccagctctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacgcactgcggagccaggagaggggtgcaggggctcctcttcttggagaccccgtggtcaagccccaggttggagtgtgaatcctgcctggccgtcaacttcccagggacttgaggggctccaccagggtcaccccgagtgtccagccccacctccagcccatcagaaacatgagtgtgagccggaccatggaggacagctgtgagctggacctggtgtacgtcacagagaggatcatcgctg

SEQ ID NO: 31304 - DNA, 7618 bp, Homo sapiens
agccagccaggaggacgggcccgcccgcgcgctactcggagcccagcctcgttgcggccatcgccctgccggaccgcgcctcaggctcccccagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaatgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattccgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttggagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaa

SEQ ID NO: 31305 - DNA, 6905 bp, Homo sapiens
agaatgggaaactgccttgggagaagccccaagtgagcccaagggcgcagagcagaaggaccctggagtgtaagagcctagattgcaagcctggcaggaggagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatgatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaatgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattccgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttggagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggt

SEQ ID NO: 31306 - DNA, 7625 bp, Homo sapiens
agaatgggaaactgccttgggagaagccccaagtgagcccaagggcgcagagcagaaggaccctggagtgtaagagcctagattgcaagcctggcaggaggagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaatgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattccgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttggagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggt

SEQ ID NO: 31307 - DNA, 698 bp, Homo sapiens
aggctggccctcagccccgggcggacattgtcctgtgagctccatgcctgcgtgctcaccgtggggccgggcacacctgccagctgctcctggctgtggttctggggactcccacactcaccaggctctcccacctggtgggctattccagctgcctcctttatgcccagagctgccgagacattaacacgaagaggggtgtgcttgactaaagcaggggaaggagcgaaacgtaggaggagctgtttctggaagggaaaagcagccctggccggtggtccctgcccaggcccagcacagctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcagg

SEQ ID NO: 31308 - DNA, 570 bp, Homo sapiens
ttgtcagtcttgatctgctacagctttgtagccagagtgaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttg

SEQ ID NO: 31309 - DNA, 1166 bp, Homo sapiens
agaatgggaaactgccttgggagaagccccaagtgagcccaagggcgcagagcagaaggaccctggagtgtaagagcctagattgcaagcctggcaggaggagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtcatgaattacaatattgcgaacatctgaagtcattttcagctccaagtgaagaaatcatggtgaaatgctacca

SEQ ID NO: 31310 - DNA, 1156 bp, Homo sapiens
agaatgggaaactgccttgggagaagccccaagtgagcccaagggcgcagagcagaaggaccctggagtgtaagagcctagattgcaagcctggcaggaggagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtcatgaattacaatattgcgaacatctgaagtcattttcagctccaagtgaagaaatcatggtta

SEQ ID NO: 31311 - DNA, 6683 bp, Homo sapiens
cgcgactcccactaggctatgagctacaggagggagggtaggtcttgctcccggagagcaccttaatcacaggcgctgaatgaaagaatgaactggttgtgcaggaaccaggatccgaacccgcctccccagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattccgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttggagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggt

SEQ ID NO: 31312 - DNA, 4759 bp, Homo sapiens
agaatgggaaactgccttgggagaagccccaagtgagcccaagggcgcagagcagaaggaccctggagtgtaagagcctagattgcaagcctggcaggaggagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaatgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagggaatcacagagacatcggggtgcccgcgatggccctcatgaagccatgcctcgacggcattcaggaagccctgcaaacgtgctttttgaactcattggccaggtgtga

SEQ ID NO: 31313 - DNA, 4070 bp, Homo sapiens
ggactctgagtcgtcttggtcccaggagccagtagtgaaggcaacagtctgcccacctgtggacaccagatcctgggagctcctggttagcaagtgagatctctgggatgtcagtgaggctggttgaagaccagaggtaaactgcagaggtcaccacccccaccatgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccagctgcttcccccagggactgggggctcccaggctgagctggcccagagcaccatgtcaatgagaaagaaggaggaatctgaagccttggacataaagtacatcgaggtgacctccgccagatcaaggtgccacgatggcccccagcactgctccagcccctctgtcaccccgcccttcggctcccttcgcagtggtggcctcctcctttccagagacgtcccccgagagacacgaagcagcagtgagagcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgcccagagggtcccgccagggacatgcagcccaccatgaagttcgtgatggacacatctaaatactggtttaagccaaacatcacccgagagcaagcaatcgagctgctgaggaaggaggagccaggggcttttgtcataagggacagctcttcataccgaggctccttcggcctggccctgaaggtgcaggaggttcccgcgtctgctcagagtcgaccaggtgaggacagcaatgacctcatccgacacttcctcatcgagtcgtctgccaaaggagtgcatctcaaaggagcagatgaggagccctactttgggagcctctctgccttcgtgtgccagcattccatcatggccctggccctgccctgcaaactcaccatcccacagagagaactgggaggtgcagatggggcctcggactctacagacagcccagcctcctgccagaagaaatctgcgggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatggaccctgagcaacggaagtggcagaagtactgcaaaccctcctggatctttgggtttgtggccaagagccagacagagcctcaggagaacgtatgccacctctttgcggagtatgacatggtccagccagcctcgcaggtcatcggcctggtgactgctctgctgcaggacgcagaaaggatgtaggggagagactgcctgtgcacctaaccaacacctccaggggctcgctaaggagcccccctccaccccctgaatgggtgtggcttgtggccatattgacagaccaatctatgggactagggggattggcatcaagttgacacccttgaacctgctatggccttcagcagtcaccatcatccagaccccccgggcctcagtttcctcaatcatagaagaagaccaatagacaagatcagctgttcttagatgctggtgggcatttgaacatgctcctccatgattctgaagcatgcacacctctgaagacccctgcatgaaaataacctccaaggaccctctgaccccatcgacctgggccctgcccacacaacagtctgagcaagagacctgcagcccctgtttcgtggcagacagcaggtgcctggcggtgacccacggggctcctggcttgcagctggtgatggtcaagaactgactacaaaacaggaatggatagactctatttccttccatatctgttcctctgttccttttcccactttctgggtggctttttgggtccacccagccaggatgctgcaggccaagctgggtgtggtatttagggcagctcagcagggggaacttgtccccatggtcagaggagacccagctgtcctgcacccccttgcagatgagtatcaccccatcttttctttccacttggtttttatttttatttttttttgagacagagtctcactgtcacccaggctgaactgcagtggtgtgatctaggctcactgcaacctccacctcccaggttcaagcaattatcctgcctcaggctcccaagtagctgggattacaggcatgtgcaactcacccagctaattttgtatttttagtagagacagggtttcaccatgttggccaggctggtcttgaactcctgaccgcaggtaatccacctgcttcggcctcccaaagtgctgggattacaggcgcaagccacccagcccagcttctttccattccttgataggcgagtattccaaagctggtatcgtagctgccctaatgttgcatattaggcggcgggggcagagataagggccatctctctgtgattctgcctcagctcctgtcttgctgagccctcccccaacccacgctccaacacacacacacacacacacacacacacacacacacacacacacacacacacacacacacgcccctctactgctatgtggcttcaaccagcctcacagccacacgggggaagcagagagtcaagaatgcaaagaggccgcttccctaagaggcttggaggagctgggctctatcccacacccacccccaccccacccccacccagcctccagaagctggaaccatttctcccgcaggcctgagttcctaaggaaaccaccctaccggggtggaagggagggtcagggaagaaacccactcttgctctacgaggagcaagtgcctgccccctcccagcagccagccctgccaaagttgcattatctttggccaaggctgggcctgacggttatgatttcagccctgggcctgcaggagaggctgagaccagcccacccagccagtggtcgagcactgccccgccgccaaagtctgcagaatgtgagatgaggttctcaaggtcacaggccccagtcccagcctgggggctggcagaggcccccatatactctgctacagctcctatcatgaaaaataaaatgtttgtctttgcaaaacagt

SEQ ID NO: 31314 - DNA, 3972 bp, Homo sapiens
ctgagtcgtcttggtcccaggagccagtagtgaaggcaacagtctgcccacctgtggacaccagatgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccagctgcttcccccagggactgggggctcccaggctgagctggcccagagcaccatgtcaatgagaaagaaggaggaatctgaagccttggacataaagtacatcgaggtgacctccgccagatcaaggtgccacgatggcccccagcactgctccagcccctctgtcaccccgcccttcggctcccttcgcagtggtggcctcctcctttccagagacgtcccccgagagacacgaagcagcagtgagagcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgcccagagggtcccgccagggacatgcagcccaccatgaagttcgtgatggacacatctaaatactggtttaagccaaacatcacccgagagcaagcaatcgagctgctgaggaaggaggagccaggggcttttgtcataagggacagctcttcataccgaggctccttcggcctggccctgaaggtgcaggaggttcccgcgtctgctcagagtcgaccaggtgaggacagcaatgacctcatccgacacttcctcatcgagtcgtctgccaaaggagtgcatctcaaaggagcagatgaggagccctactttgggagcctctctgccttcgtgtgccagcattccatcatggccctggccctgccctgcaaactcaccatcccacagagagaactgggaggtgcagatggggcctcggactctacagacagcccagcctcctgccagaagaaatctgcgggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatggaccctgagcaacggaagtggcagaagtactgcaaaccctcctggatctttgggtttgtggccaagagccagacagagcctcaggagaacgtatgccacctctttgcggagtatgacatggtccagccagcctcgcaggtcatcggcctggtgactgctctgctgcaggacgcagaaaggatgtaggggagagactgcctgtgcacctaaccaacacctccaggggctcgctaaggagcccccctccaccccctgaatgggtgtggcttgtggccatattgacagaccaatctatgggactagggggattggcatcaagttgacacccttgaacctgctatggccttcagcagtcaccatcatccagaccccccgggcctcagtttcctcaatcatagaagaagaccaatagacaagatcagctgttcttagatgctggtgggcatttgaacatgctcctccatgattctgaagcatgcacacctctgaagacccctgcatgaaaataacctccaaggaccctctgaccccatcgacctgggccctgcccacacaacagtctgagcaagagacctgcagcccctgtttcgtggcagacagcaggtgcctggcggtgacccacggggctcctggcttgcagctggtgatggtcaagaactgactacaaaacaggaatggatagactctatttccttccatatctgttcctctgttccttttcccactttctgggtggctttttgggtccacccagccaggatgctgcaggccaagctgggtgtggtatttagggcagctcagcagggggaacttgtccccatggtcagaggagacccagctgtcctgcacccccttgcagatgagtatcaccccatcttttctttccacttggtttttatttttatttttttttgagacagagtctcactgtcacccaggctgaactgcagtggtgtgatctaggctcactgcaacctccacctcccaggttcaagcaattatcctgcctcaggctcccaagtagctgggattacaggcatgtgcaactcacccagctaattttgtatttttagtagagacagggtttcaccatgttggccaggctggtcttgaactcctgaccgcaggtaatccacctgcttcggcctcccaaagtgctgggattacaggcgcaagccacccagcccagcttctttccattccttgataggcgagtattccaaagctggtatcgtagctgccctaatgttgcatattaggcggcgggggcagagataagggccatctctctgtgattctgcctcagctcctgtcttgctgagccctcccccaacccacgctccaacacacacacacacacacacacacacacacacacacacacacacacacacacacacacacgcccctctactgctatgtggcttcaaccagcctcacagccacacgggggaagcagagagtcaagaatgcaaagaggccgcttccctaagaggcttggaggagctgggctctatcccacacccacccccaccccacccccacccagcctccagaagctggaaccatttctcccgcaggcctgagttcctaaggaaaccaccctaccggggtggaagggagggtcagggaagaaacccactcttgctctacgaggagcaagtgcctgccccctcccagcagccagccctgccaaagttgcattatctttggccaaggctgggcctgacggttatgatttcagccctgggcctgcaggagaggctgagaccagcccacccagccagtggtcgagcactgccccgccgccaaagtctgcagaatgtgagatgaggttctcaaggtcacaggccccagtcccagcctgggggctggcagaggcccccatatactctgctacagctcctatcatgaaaaataaaatgtttgtctttgcaaaacagtaa

SEQ ID NO: 31315 - DNA, 2174 bp, Homo sapiens
ggaggtgggagatcttcaaagggattcatgaggcctgttcctgtgagaggggtccattcactccacccccgcccctttggggggcctgtttctttgccttggctcagaactgggaggtgcagatggggcctcggactctacagacagcccagcctcctgccagaagaaatctgcggggtgtttttccggcgccattacccactcaccaccctccgcttctgtggtatggaccctgagcaacggaagtggcagaagtactgcaaaccctcctggatctttgggtttgtggccaagagccagacagagcctcaggagaacgtatgccacctctttgcggagtatgacatggtccagccagcctcgcaggtcatcggcctggtgactgctctgctgcaggacgcagaaaggatgtaggggagagactgcctgtgcacctaaccaacacctccaggggctcgctaaggagcccccctccaccccctgaatgggtgtggcttgtggccatattgacagaccaatctatgggactagggggattggcatcaagttgacacccttgaacctgctatggccttcagcagtcaccatcatccagaccccccgggcctcagtttcctcaatcatagaagaagaccaatagacaagatcagctgttcttagatgctggtgggcatttgaacatgctcctccatgattctgaagcatgcacacctctgaagacccctgcatgaaaataacctccaaggaccctctgaccccatcgacctgggccctgcccacacaacagtctgagcaagagacctgcagcccctgtttcgtggcagacagcaggtgcctggcggtgacccacggggctcctggcttgcagctggtgatggtcaagaactgactacaaaacaggaatggatagactctatttccttccatatctgttcctctgttccttttcccactttctgggtggctttttgggtccacccagccaggatgctgcaggccaagctgggtgtggtatttagggcagctcagcagggggaacttgtccccatggtcagaggagacccagctgtcctgcacccccttgcagatgagtatcaccccatcttttctttccacttggtttttatttttatttttttttgagacagagtctcactgtcacccaggctgaactgcagtggtgtgatctaggctcactgcaacctccacctcccaggttcaagcaattatcctgcctcaggctcccaagtagctgggattacaggcatgtgcaactcacccagctaattttgtatttttagtagagacagggtttcaccatgttggccaggctggtcttgaactcctgaccgcaggtaatccacctgcttcggcctcccaaagtgctgggattacaggcgcaagccacccagcccagcttctttccattccttgataggcgagtattccaaagctggtatcgtagctgccctaatgttgcatattaggcggcgggggcagagataagggccatctctctgtgattctgcctcagctcctgtcttgctgagccctcccccaacccacgctccaacacacacacacacacacacacacacacacacacacacacacacacacacacacacacacgcccctctactgctatgtggcttcaaccagcctcacagccacacgggggaagcagagagtcaagaatgcaaagaggccgcttccctaagaggcttggaggagctgggctctatcccacacccacccccaccccacccccacccagcctccagaagctggaaccatttctcccgcaggcctgagttcctaaggaaaccaccctaccggggtggaagggagggtcagggaagaaacccactcttgctctacgaggagcaagtgcctgccccctcccagcagccagccctgccaaagttgcattatctttggccaaggctgggcctgacggttatgatttcagccctgggcctgcaggagaggctgagaccagcccacccagccagtggtcgagcactgccccgccgccaaagtctgcagaatgtgagatgaggttctcaaggtcacaggccccagtcccagcctgggggctggcagaggcccccatatactctgctacagctcctatcatgaaaaataaaatgtttgtctttgcaaaacagtaa

SEQ ID NO: 31316 - DNA, 5010 bp, Homo sapiens
gggggagcaaaagatcacaggctgacactcccagcagggtagatcctgggaatctgatctcctggcctcccccacatcctcccccctccacttcctggagcagcgacctgcccccttcccgcctgcacttccctccacttccagggccgggcttctcctcacaccagccagacagcctaccctccgcccaggggaagcggctgcctccgccaggccgcttccaggaagccccgggccaggccccagcattgttcaggccctggggccagcaccccagccagccgaacaccatgaagtccagcggccctgtggagaggctgctcagagccctggggaggagggacagcagccgggccgcaagcaggcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaacttta

SEQ ID NO: 31317 - DNA, 4944 bp, Homo sapiens
gcacattctttcaagtgacagctatagcctgtcccaggggctgctgtccacagcttggggctgaagactcccaggccattaaccccttagcttttaggaagattactccccctttttcaaggccccatccacctccctcccttgactcccaggacgggaagttggccatgttcccaggagggaggccggaggcccatggatgggggtggagtatgtgttgggaggggggacctcctgtccagtcctcaggccctgggacagctgctgaggaaggagagcagacccaggagagccatgaagcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaacttt

SEQ ID NO: 31318 - DNA, 4737 bp, Homo sapiens
caactctctccccctctcagccacttcctgtctccagtatgtccctggcgcggcccggctggccgtctgcgcaccctctctcccctcggctctttcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaact

SEQ ID NO: 31319 - DNA, 3125 bp, Homo sapiens
gggggagcaaaagatcacaggctgacactcccagcagggtagatcctgggaatctgatctcctggcctcccccacatcctcccccctccacttcctggagcagcgacctgcccccttcccgcctgcacttccctccacttccagggccgggcttctcctcacaccagccagacagcctaccctccgcccaggggaagcggctgcctccgccaggccgcttccaggaagccccgggccaggccccagcattgttcaggccctggggccagcaccccagccagccgaacaccatgaagtccagcggccctgtggagaggctgctcagagccctggggaggagggacagcagccgggccgcaagcaggcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaacttt

SEQ ID NO: 31320 - DNA, 4979 bp, Homo sapiens
gggggagcaaaagatcacaggctgacactcccagcagggtagatcctgggaatctgatctcctggcctcccccacatcctcccccctccacttcctggagcagcgacctgcccccttcccgcctgcacttccctccacttccagggccgggcttctcctcacaccagccagacagcctaccctccgcccaggggaagcggctgcctccgccaggccgcttccaggaagccccgggccaggccccagcattgttcaggccctggggccagcaccccagccagccgaacaccatgaagtccagcggccctgtggagaggctgctcagagccctggggaggagggacagcagccgggccgcaagcaggcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaacttt

SEQ ID NO: 31321 - DNA, 2513 bp, Homo sapiens
tctatctcagtttcaagcttcctagtcttccccacacacacacacctagctcctcaggcggagagcacccctttcttggccacccgggtatcccccagggggagtacggggctcaaaacacccttctggaaaaacaaaggtggaagcaaatttcaggaagtaaaacttcctgaaataaaataaaatatcgaatgccttgagacccatacattttcaggttttcctaattaaagcaattactttccaccacccctccaacctggaatcaccaacttgattagagaaactgatttttcttttttctttttttttcccaaaagagtacctctgatcattttagcctgcaactaatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacagtgtgatttggatcatggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaa

SEQ ID NO: 31322 - DNA, 1771 bp, Homo sapiens
cctggatgttcaagggaacaatgacagagtgtgatttggatcatggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacct

SEQ ID NO: 31323 - DNA, 1041 bp, Homo sapiens
accgcggcgcgccgccctccgccgttatatgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaaggtttgttaatta

SEQ ID NO: 31324 - DNA, 1017 bp, Homo sapiens
gttatatgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaaggtttgttaatt

SEQ ID NO: 31325 - DNA, 936 bp, Homo sapiens
gttatatgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaaggtttgttaatt
